(12) United States Patent
Shaw et al.

(10) Patent No.: US 12,503,687 B2
(45) Date of Patent: *Dec. 23, 2025

(54) THERAPEUTIC BACTERIOPHAGE COMPOSITIONS

(71) Applicant: Armata Pharmaceuticals, Inc., Marina del Rey, CA (US)

(72) Inventors: Karen Joy Shaw, Glen Allen, VA (US); Sandra P. Morales, Sydney (AU); Gillian Mearns, Sydney (AU); Deborah A. Rankin, Sydney (AU); Frenk Smrekar, Ljubjlana (SI)

(73) Assignee: ARMATA PHARMACEUTICALS, INC.

( * ) Notice: Subject to any disclaimer, the term of this patent is extended or adjusted under 35 U.S.C. 154(b) by 0 days.

This patent is subject to a terminal disclaimer.

(21) Appl. No.: 18/049,382

(22) Filed: Oct. 25, 2022

(65) Prior Publication Data
US 2023/0272352 A1 Aug. 31, 2023

Related U.S. Application Data

(63) Continuation of application No. 16/485,408, filed as application No. PCT/GB2017/050376 on Feb. 13, 2017, now abandoned.

(51) Int. Cl.
*A61K 39/02* (2006.01)
*A61K 35/76* (2015.01)
*C12N 7/00* (2006.01)

(52) U.S. Cl.
CPC ............... *C12N 7/00* (2013.01); *A61K 35/76* (2013.01); *C12N 2795/00032* (2013.01)

(58) Field of Classification Search
None
See application file for complete search history.

(56) References Cited

U.S. PATENT DOCUMENTS

| 8,388,946 | B2 | 3/2013 | Soothill et al. |
| 8,475,787 | B2 | 7/2013 | Harper |
| 9,623,058 | B2 | 4/2017 | Jia |
| 10,517,908 | B2 | 12/2019 | Shaw et al. |
| 11,253,557 | B2 | 2/2022 | Shaw et al. |
| 2011/0182863 | A1 | 7/2011 | Jia |
| 2015/0132263 | A1 | 5/2015 | Liu et al. |
| 2015/0216179 | A1 | 8/2015 | Jia |
| 2017/0065649 | A1 | 3/2017 | Shaw |
| 2018/0289756 | A1 | 10/2018 | Harper et al. |
| 2019/0359947 | A1 | 11/2019 | Shaw et al. |
| 2020/0171108 | A1 | 6/2020 | Shaw et al. |
| 2021/0077551 | A1 | 3/2021 | Morales et al. |
| 2023/0248789 | A1 | 8/2023 | Morales et al. |

FOREIGN PATENT DOCUMENTS

| CN | 104519893 | A | 4/2015 |
| JP | 2007259856 | A | 10/2007 |
| JP | 2015512384 | A | 4/2015 |
| JP | 2020520980 | A | 7/2020 |
| WO | 9603649 | A1 | 2/1996 |
| WO | 2005009451 | A1 | 2/2005 |
| WO | 2008110840 | A1 | 9/2008 |
| WO | 2009044163 | A2 | 4/2009 |
| WO | 2013141730 | A1 | 9/2013 |
| WO | 2013164640 | A1 | 11/2013 |
| WO | 2016066722 | A2 | 5/2016 |
| WO | 2017015652 | A1 | 1/2017 |
| WO | 2018146437 | A1 | 8/2018 |
| WO | 2019136109 | A1 | 7/2019 |

OTHER PUBLICATIONS

International Search Report and Written Opinion received for PCT Application No. PCT/GB2017/050376, mailed on Sep. 15, 2017, 12 pages.
Zhang et al. (Mar. 1, 2018) "Bacteriophage Effectively Kills Multidrug Resistant *Staphylococcus aureus* Clinical Isolates from Chronic Rhinosinusitis Patients", International Forum of Allergy & Rhinology, 8(3):406-414.
ANZCTR (Dec. 14, 2016) "A Phase 1 Investigator Initiated Study to Evaluate the Safety, Tolerability and Preliminary Effectiveness of AB-SA01 in Patients with Chronic Rhinosinusitis Associated with Staphylococcus aureus Infection", Trial Registered on ANZCTR, Australian New Zealand Clinical Trials Registry, 7 pages.
Ali et al. (2015) "Efficacy of Bacteriophage-Antibiotic Combinations against *Staphylococcus aureus* Infections: In vitro Study", International Journal of Pharmaceutical Sciences Review and Research, 34(1):186-189.
Alves et al. (Nov. 2014) "Combined use of Bacteriophage K and a Novel Bacteriophage to Reduce *Staphylococcus aureus* Biofilm", Applied and Environmental Microbiology, 80(21):6694-6703.
AMPLIPHI "AmpliPhi Biosciences Reports Favorable Final Results From Phase 1 Trial of AB-SA01 in Chronic Rhinosinusitis Patients", AmpliPhi Biosciences Corporation, 03 pages.
Attwood, Teresa K. (Oct. 27, 2000) "The Babel of Bioinformatics", Science, 290(5491):471-473.
Baker et al. (2001) "Protein Structure Predication and Structural Genomics", Science, 294(5540):93-96.
Barr et al. (1987) "Value of charcoal media for recovering staphylococci incorporated in mupirocin ointment", Journal of Clinical Pathology, 40(4):372-376.
Bautz, David (Mar. 9, 2016) "APHB: Early Signs of Efficacy Seen in Phase 1 Trial of AB-SA01 in Chronic Rhinosinusitis", Zacks SCR, 04 pages.
Bautz et al. (Nov. 2016) "APHB: Safety of AB-SA01 Firmly Established Following Phase 1 Trials", Zacks SCR, 03 pages.
Carlson et al. (2005) "Appendix: Working with Bacteriophages: Common Techniques and Methodological Approaches", CRC Press, 58 pages.

(Continued)

*Primary Examiner* — Jennifer E Graser
(74) *Attorney, Agent, or Firm* — Mintz, Levin, Cohn, Ferris, Glovsky and Popeo, P.C.

(57) ABSTRACT

The present invention relates to a bacteriophage composition comprising one or more (suitably two or more, or three) bacteriophages selected from Sa87, J-Sa36, or Sa83, or mutants thereof. Also encompassed are the use of said bacteriophage compositions for medical or non-medical applications, as well as kits, bandages, and wound dressings comprising said bacteriophage compositions.

31 Claims, 1 Drawing Sheet

Specification includes a Sequence Listing.

(56) References Cited

OTHER PUBLICATIONS

Darling et al. (2004) "Mauve: Multiple Alignment of Conserved Genomic Sequence With Rearrangements", Genome Res., 14(7):1394-1403.

Drilling et al. (Jan.-Feb. 2014) "Bacteriophage Reduces Biofilm of Staphylococcus Aureus Ex Vivo Isolates from Chronic Rhinosinusitis Patients", American Journal of Rhinology & Allergy, 28(1):3-11.

Hyman et al. (2009) "Practical methods for determining phage growth parameters", Bacteriophages, Humana Press, 501(18):175-202.

Kelly et al. (Jan./Feb. 2011) "Development of a broad-host-range phage cocktail for biocontrol", Bioengineered Bugs, 2(1):31-37.

Kirby, Amy E. (2012) "Synergistic Action of Gentamicin and Bacteriophage in a Continuous Culture Population of *Staphylococcus aureus*", PLoS One, e51017, 7(11):9 pages.

Lehman et al. (2019) "Design and Preclinical Development of a Phage Product for the Treatment of Antibiotic-Resistant *Staphylococcus aureus* Infections", Viruses, 11(88):16 pages.

Magiorakos et al. (Mar. 2012) "Multidrug-Resistant, Extensively Drug-Resistant And Pandrug-Resistant Bacteria: An International Expert Proposal For Interim Standard Definitions For Acquired Resistance", Clinical Microbiology and Infection, 18(3):268-281.

Otter et al. (2010) "Molecular Epidemiology of Community-associated Meticillin-resistant *Staphylococcus aureus* in Europe", Lancet, 10(4):227-239.

Ryan et al. (2011) "Recent Advances in Bacteriophage Therapy: How Delivery Routes, Formulation, Concentration and Timing Influence the Success of Phage Therapy", Journal of Pharmacy and Pharmacology, 63:1253-1264.

Shaw et al. (Jul. 1, 2017) "Efficacy of a Bacteriophage Cocktail in a *Staphylococcus aureus* Mouse Pneumonia Model is Comparable to Vancomycin", Ampliphi Biosciences Corporation, 01 page.

Thompson et al. (Nov. 11, 1994) "CLUSTAL W: Improving the Sensitivity of Progressive Multiple Sequence Alignment through Sequence Weighting, Position-Specific Gap Penalties and Weight Matrix Choice", Nucleic Acids Research, 22:4673-4680.

Walle et al. (Jun. 12, 2004) "Align-M—A New Algorithm for Multiple Alignment of Highly Divergent Sequences, Bioinformatics", Bioinformatics, 20(9):1428-1435.

World Health Organization (Jan. 6, 2016) "A Phase 1 Investigator Initiated Study to Evaluate the Safety, Tolerability and Preliminary Effectiveness of AB-SA01 in Patients with Chronic Rhinosinusitis Associated with *Staphylococcus aureus* Infection", International Clinical Trials Registry Platform, 3 pages.

World Health Organization (Jan. 9, 2017) "International Clinical Trials Registry Platform, A phase 1 investigator initialed study to evaluate the safety, tolerability and preliminary effectiveness of AB-SA01 in patients with chronic rhinosinusitis associated with *Staphylococcus aureus* infection", 2 pages.

"Molecular Respiratory Disease", 8(4):331-333.

Abedon et al. (2011) "Phage Treatment of Human Infections", Bacteriophage, 1(2):66-85.

Adriaenssens et al. (2017) "How to Name and Classify Your Phage: An Informal Guide", Viruses, 9(4):70.

(Feb. 2017) ECACC Accession No. 17020901 (Sa87). European Collection of Authenticated Cell Cultures (ECACC), 4 pages.

(Feb. 2017) ECACC Accession No. 17020902 (Sa83), European Collection of Authenticated Cell Cultures (ECACC), 4 pages.

(Feb. 2017) ECACC Accession No. 17020903 (J-Sa36), European Collection of Authenticated Cell Cultures (ECACC), 4 pages.

(Retrieved on Aug. 23, 2024) Hypothetical Protein Pmar_PMAR024297, Partial [Perkinsus Marinus ATCC 50983], NCBI Reference Sequence: XP_002772975.1, 1 page.

Montanaro et al. (2011) "Scenery of *Staphylococcus* Implant Infections in Orthopedics". Future Microbiology, 6(11):1329-1349.

Oka et al. (1986) *Staphylococcal bacteremia*, The Study of *Staphylococcus aureus* Sepsis, The Second Report, The Clinical Examination of 93 Cases of *Staphylococcus aureus* Sepsis in Older Adults, The Journal of the Japanese Association for Infectious Diseases, 60(6), 4 pages. (only abstract submitted).

Petti et al. (2002) "*Staphylococcus aureus* Bacteremia and Endocarditis", Infectious Disease Clinics of North America, 16(2):413-435.

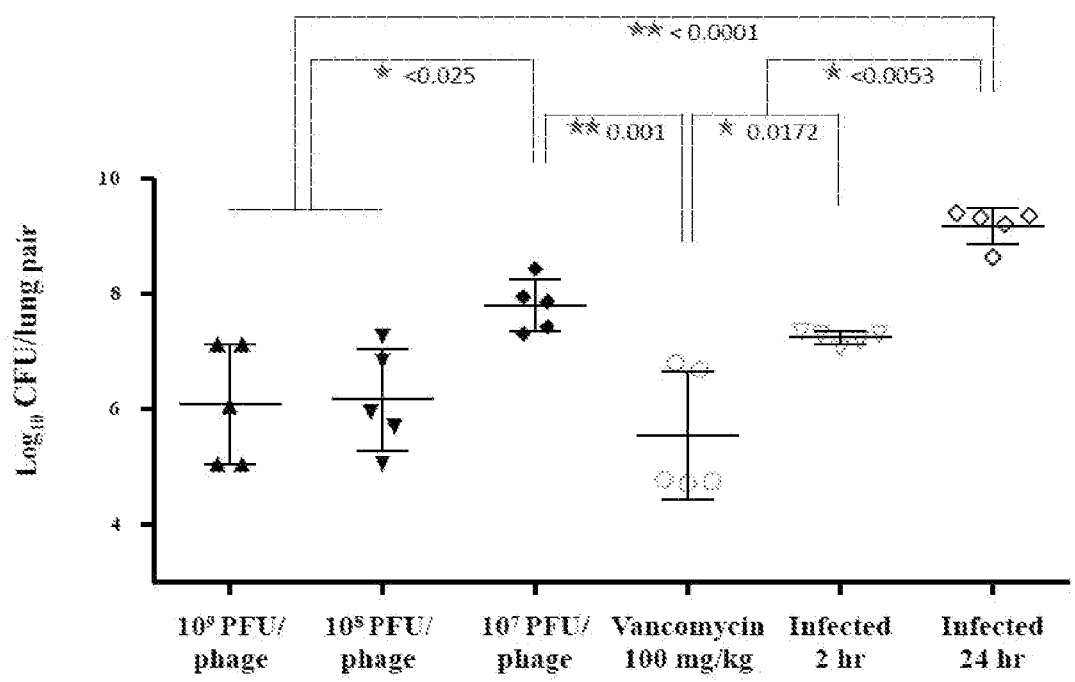

THERAPEUTIC BACTERIOPHAGE COMPOSITIONS

CROSS-REFERENCES TO RELATED APPLICATIONS

This application is a continuation application of U.S. application Ser. No. 16/485,408, filed Aug. 12, 2019; which is a National Stage Entry of PCT Application No. PCT/GB17/50376, filed Feb. 13, 2017, both of which are incorporated herein by reference in their entirety and for all purposes.

SEQUENCE LISTING

The instant application contains a Sequence Listing, which has been submitted electronically in ASCII format and is hereby incorporated by reference in its entirety. Said ASCII copy, created on Oct. 9, 2024 is named "2024-10-08 Revised_Sequence_Listing_ST26 054249-510C02US.xml" and is 577,777 bytes in size.

The present invention relates to compositions of bacteriophages, and use of the same for medical and non-medical applications.

In recent years the widespread use of antibacterial agents, typically in the form of small-molecule (chemical) antibiotics, such as penicillin or tetracycline, has led to a huge increase in antibiotic-resistant bacterial strains. Mutations conferring antibiotic resistance, or genes encoding antibiotic resistance enzymes, such as penicillinases, are becoming increasingly common in pathogenic bacteria worldwide. Methicillin-resistant *Staphylococcus aureus* (MRSA) bacteria, for example, are an increasingly common form of infection, often acquired following surgery or other invasive treatment in a clinical setting. MRSA infections are extremely difficult to treat using conventional antibiotics.

Owing to an increase in the prevalence of pathogenic bacteria exhibiting resistance to antibacterial agents, and in particular so-called antibiotics of last resort (e.g. methicillin, vancomycin, etc.), there is a need for alternative antibacterial agents and therapeutic strategies.

Bacteriophages are targeted therapeutics capable of infecting specific bacterial species or strains. Bacteriophage-target binding is facilitated by way of viral structural elements, such as tail fibres. Viral nucleic acid, usually encased within the bacteriophage head, is then injected (typically via the tail) into the bacterial target cell. In the case of obligate lytic bacteriophages, the injected viral nucleic acid directs the production of bacteriophage progeny using the intracellular mechanisms of the bacterium. The host cell is killed by lysis at the end of the cell cycle with a concomitant release of viral progeny.

In one aspect the present invention provides a bacteriophage composition comprising one or more bacteriophage(s) selected from Sa87 (SEQ ID NO:2), J-Sa36 (SEQ ID NO:3), Sa83 (SEQ ID NO:4), or mutants thereof. Said bacteriophage composition is an alternative to conventional antibacterial agents/therapeutics, and overcomes one or more problems associated therewith.

The bacteriophage composition of the present invention is particularly advantageous for use in medicine, and shows clinical efficacy in the treatment of *Staphylococcus aureus* infections. For example, it has surprisingly been found that said bacteriophage composition is particularly suited to treatment of *Staphylococcus aureus* pulmonary infections. Additionally, the bacteriophage composition of the invention is efficacious against a broad spectrum of *Staphylococcus aureus* strains.

A bacteriophage composition comprising (or consisting essentially of) Sa87 (SEQ ID NO:2), J-Sa36 (SEQ ID NO:3), and Sa83 (SEQ ID NO:4) (optionally further including one or more mutants thereof) surprisingly exhibits reduced bacteriophage antagonism and/or reduces development of resistance in *Staphylococcus aureus* target bacteria, for example when compared to a composition comprising (or consisting essentially of) Sa87 (SEQ ID NO:2), J-Sa36 (SEQ ID NO:3), Sa83 (SEQ ID NO:4), and J-Sa37 (optionally further including one or more mutants thereof).

The bacteriophages Sa87 (SEQ ID NO:2), J-Sa36 (SEQ ID NO:3), and Sa83 (SEQ ID NO:4), were deposited at the European Collection of Cell Cultures (ECACC), Culture Collections, Public Health England, Porton Down, Salisbury, Wiltshire, SP4 0JG, United Kingdom, on 9 Feb. 2017 under ECACC accession numbers 17020901 (Sa87), 17020903 (J-Sa36), and 17020902 (Sa83). All of the deposits were made under the provisions of the Budapest Treaty on the International Recognition of the Deposit of Microorganisms for the Purposes of Patent Procedure.

In one embodiment a bacteriophage composition comprises at least two bacteriophages selected from Sa87 (SEQ ID NO:2), J-Sa36 (SEQ ID NO:3), Sa83 (SEQ ID NO:4), or mutants thereof. A bacteriophage composition comprising at least two bacteriophages may be referred to herein as a "panel" of bacteriophages. In one embodiment a bacteriophage composition comprises Sa87 (SEQ ID NO:2), J-Sa36 (SEQ ID NO:3), Sa83 (SEQ ID NO:4) or mutants thereof. Suitably a bacteriophage composition may comprise Sa87 (SEQ ID NO:2), J-Sa36 (SEQ ID NO:3), and Sa83 (SEQ ID NO:4). In one embodiment a bacteriophage composition consists essentially of Sa87 (SEQ ID NO:2), J-Sa36 (SEQ ID NO:3), and Sa83 (SEQ ID NO:4) or mutants thereof. Suitably a bacteriophage composition consists essentially of Sa87 (SEQ ID NO:2), J-Sa36 (SEQ ID NO:3), and Sa83 (SEQ ID NO:4).

The term "consists essentially of" as used herein means that only the bacteriophage(s) explicitly indicated are present in the bacteriophage composition, but that said composition may also contain a further non-bacteriophage constituent, such as an appropriate carrier, diluent, etc.

The term "mutant" as used herein refers to a bacteriophage differing genetically from Sa87 (SEQ ID NO:2), J-Sa36 (SEQ ID NO:3), or Sa83 (SEQ ID NO:4) by one or more nucleotide(s) but still retaining the ability to infect and lyse a *Staphylococcus aureus* target bacteria. In one embodiment (alternatively or additionally) a "mutant" bacteriophage is capable of lysing the same target bacterial strains as Sa87 (SEQ ID NO:2), J-Sa36 (SEQ ID NO:3), and/or Sa83 (SEQ ID NO:4), and further capable of lysing one or more additional bacterial strains. In one embodiment a mutant may have at least 75%, 80%, 85%, 90%, 95% or 99% sequence identity across its entire genome when compared to Sa87 (SEQ ID NO:2), J-Sa36 (SEQ ID NO:3), or Sa83 (SEQ ID NO:4).

In one embodiment a "mutant" may be a bacteriophage progeny. A bacteriophage progeny may be a bacteriophage obtainable after lysing a *Staphylococcus aureus* target bacteria using a bacteriophage of the invention (i.e. the "parent bacteriophage"). In other words, the bacteriophage progeny may be a second (or further) generation bacteriophage.

In one embodiment a bacteriophage progeny is obtainable by: contacting one or more bacteriophage(s) Sa87 (SEQ ID NO:2), J-Sa36 (SEQ ID NO:3) and/or Sa83 (SEQ ID NO:4)

with a *Staphylococcus aureus* target bacteria such that the one or more bacteriophage(s) infects and lyses said target bacteria; and obtaining a bacteriophage released following lysis of said target bacteria. Said bacteriophage progeny will typically comprise one or more nucleotide(s) mutation(s) when compared to the relevant parent bacteriophage.

The term "obtainable" as used herein also encompasses the term "obtained". In one embodiment the term "obtainable" means obtained.

Any of a variety of sequence alignment methods can be used to determine percent identity, including, without limitation, global methods, local methods and hybrid methods, such as segment approach methods. Protocols to determine percent identity are routine procedures within the scope of one skilled in the art. Global methods align sequences from the beginning to the end of the molecule and determine the best alignment by adding up scores of individual nucleotide pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) Nucleic Acids Research 4673-4880 (1994); and iterative refinement. Non-limiting methods include, e.g., BLAST, Match-box, see, e.g., Align-M, see, e.g., Ivo Van Walle et al., Align-M—A New Algorithm for Multiple Alignment of Highly Divergent Sequences, 20(9) Bioinformatics: 1428-1435 (2004).

The bacteriophage composition of the invention targets one or more *Staphylococcus aureus* strain(s). In one embodiment a *Staphylococcus aureus* strain targeted is a methicillin-resistant *Staphylococcus aureus* (MRSA). In another embodiment a *Staphylococcus aureus* strain targeted is a vancomycin-resistant *Staphylococcus aureus* (VRSA).

The bacteriophages of a composition of the invention may be provided in the form of a single therapeutic composition (preferred) or as a number of separate compositions each comprising one or more members of the composition. In embodiments where the bacteriophages are provided in a number of separate compositions, said bacteriophages may be administered to a subject sequentially or simultaneously (suitably simultaneously).

A bacteriophage for inclusion in a composition of the invention may be propagated by any suitable method known in the art. For example one or more bacteriophage(s) may be grown separately in host bacterial strains capable of supporting growth of the bacteriophage. Typically, the bacteriophage will be grown in said host bacterial strain to high concentrations, titrated and combined to form a composition of the invention.

The amount of each bacteriophage employed (e.g. in a bacteriophage composition, method or use of the invention) will depend upon its virulence against the target bacterial species.

Count bacterial strains may be used in the development of a composition, i.e. bacterial strains which are indicators for individual prospective members of the composition (e.g. panel). A count strain may permit at least 1000 times more plaque formation by one prospective member of the bacteriophage composition than any other. In this way, a composition (e.g. panel) that is consistently effective against a wide range of bacterial isolates may be achieved.

Typically, said one or more bacteriophage(s) may be combined to form a composition comprising at least about $1 \times 10^7$, $1 \times 10^8$, $1 \times 10^9$ or $1 \times 10^{10}$, or $1 \times 10^{11}$ plaque forming units (PFU) of each phage per ml of composition. Suitably, said one or more bacteriophage(s) may be combined to form a composition comprising at least about $1 \times 10^8$ or $1 \times 10^9$ PFU of each phage per ml of composition.

When selecting bacteriophages for inclusion in a composition of the invention, the methods taught in WO 2013/164640 A1 (incorporated herein by reference) may be used. In one embodiment said method comprises:

a. providing two or more different bacteriophages, wherein each of said two or more different bacteriophages independently retards growth of a target species or strain;

b. combining at least two of said two or more different bacteriophages; and c. determining growth of the target species or strain in the presence of said combination of two or more different bacteriophages, wherein the target species or strain growth conditions are the same or equivalent in steps a. and c.;

d. wherein, when said combination retards growth of the target species or strain at least equal to the greatest growth retardation achieved independently by any one of said two or more different bacteriophages, the combination is accepted as a composition of bacteriophages; and e. wherein, when said combination retards growth of the target bacterial species or strain less than the greatest growth retardation achieved independently by any one of said two or more different bacteriophages, the combination is initially rejected as a composition of bacteriophages. Suitably the target may be a *Staphylococcus aureus* target bacterial strain.

The present inventors have surprisingly found that by employing a method of the foregoing embodiment, an improved bacteriophage composition (comprising bacteriophages Sa87 (SEQ ID NO:2), J-Sa36 (SEQ ID NO:3) and Sa83 (SEQ ID NO:4) (and optionally mutants thereof)) is obtained. Advantageously, said bacteriophage composition exhibits improved therapeutic efficacy against *Staphylococcus aureus* when compared to conventional bacteriophage compositions and/or a composition comprising bacteriophages Sa87 (SEQ ID NO:2), J-Sa36 (SEQ ID NO:3), Sa83 (SEQ ID NO:4), and J-Sa37 (and optionally mutants thereof). Thus, a preferred bacteriophage composition comprises or consists essentially of Sa87 (SEQ ID NO:2), J-Sa36 (SEQ ID NO:3) and Sa83 (SEQ ID NO:4).

In some embodiments a bacteriophage composition of the present invention may further comprise one or more additional bacteriophages. Said one or more additional bacteriophages may target a *Staphylococcus aureus* species or strain, or a different bacterial target, for example selected from one or more of the following genera *Staphylococcus, Helicobacter, Klebsiella, Listeria, Mycobacterium, Escherichia, Meningococcus, Campylobacter, Streptococcus, Enterococcus, Shigella, Pseudomonas* (e.g. *Pseudomonas aeruginosa*), *Burkholderia, Clostridium, Legionella, Acetinobacter, Salmonella,* or combinations thereof.

The one or more additional bacteriophage(s) may be one taught in WO 2009/044163 (incorporated herein by reference), a bacteriophage K and/or bacteriophage P68 described therein.

In one embodiment the one or more additional bacteriophage(S) may be one or more taught in WO 2005/009451 A1, which is incorporated herein by reference. Suitably said one or more additional bacteriophage(s) may target *Pseudomonas* bacteria, such as *Pseudomonas aeruginosa* bacteria.

In one embodiment a composition of the invention comprises one or more bacteriophage(s) taught in WO 2013/

068743 A9 (incorporated herein by reference). In one embodiment a composition of the invention comprises a *Staphylococcus* bacteriophage K mutant, which comprises one or more mutations within one or more of the following regions, corresponding to the nucleotide sequence of wild-type *Staphylococcus* bacteriophage K (SEQ ID No. 1), selected from:

a) the region between ORF 18 and ORF 19; and/or
b) the region between ORF 41 and ORF 42; and/or
c) ORF 68; and/or
d) an overlapping region within ORF 86/88/90; and/or
e) ORF 92; and/or
f) ORF 93; and/or
g) ORF 96; and/or
h) ORF 100.

Preferably, the *Staphylococcus* bacteriophage K mutant comprises (or consists of) mutations in all of the regions referred to above.

The ORF designations referred to above may be identified using GeneMark software (http://exon.biology.gatech.edu/). The individual reading frames may then be compared against the NCBI GenBank using BLAST and the highest scoring matches then attributed to the respective ORF. Suitably, the ORFs referred to above may be the bacteriophage K ORFs described by O'Flaherty S. et al. (J. Bacteriol. (2004), 186(9) 2862-2871), the teaching of which is incorporated herein by reference.

In one embodiment SEQ ID No. 1 comprises 118 ORFs. The ORFs may be annotated as follows (nucleotide numbering indicated is that of SEQ ID No. 1 and is orientated from start codon to stop codon): ORF 1: 2934-2449; ORF 2: 3358 2927; ORF 3: 3914-3372; ORF 4: 4414-3926; ORF 5: 4825-4427; ORF 6: 5529-4822; ORF 7: 6183-5629; ORF 8: 8050-7502; ORF 9: 9194-8457; ORF 10: 10003-9614; ORF 11: 10798-10316; ORF 12: 11390-10848; ORF 13: 11923-11390; ORF 14: 13213-12368; ORF 15: 13809-13225; ORF 16: 15233-14817; ORF 17: 15669-15367; ORF 18: 18110-16062; ORF 19: 19226-18648; ORF 20: 19845-19219; ORF 21: 20734-19838; ORF 22: 21767-21027; ORF 23: 22433-21819; ORF 24: 22874-22449; ORF 25: 23719-23078; ORF 26: 24971-24279; ORF 27: 25793-25158; ORF 28: 26651-25860; ORF 29: 26959-26651; ORF 30: 27701-27072; ORF 31: 28472-27972; ORF 32: 29435-28632; ORF 33: 29938-29435; ORF 34: 34507-34833; ORF 35: 34848-36665; ORF 36: 36658-37479; ORF 37: 37636-38115; ORF 38: 38157-39350; ORF 39: 39435-39776; ORF 40: 39794-40165; ORF 41: 40169-41860; ORF 42: 42054-42827; ORF 43: 42846-43796; ORF 44: 43912-45303; ORF 45: 45704-46612; ORF 46: 46626-47504; ORF 47: 47504-48124; ORF 48: 48143-48979; ORF 49: 49223-50986; ORF 50: 51059-51487; ORF 51: 51767-52225; ORF 52: 52514-52825; ORF 53: 52957-53415; ORF 54: 53459-53995; ORF 55: 54051-58106; ORF 56: 58185-60611; ORF 57: 60625-61512; ORF 58: 61512-64058; ORF 59: 64165-64956; ORF 60: 64956-65480; ORF 61: 65480-66184; ORF 62: 66199-67245; ORF 63: 67266-70325; ORF 64: 70436-70957; ORF 65: 70978-74436; ORF 66: 74644-76566; ORF 67: 76589-76963; ORF 68: 76970-78346; ORF 69: 78438-80186; ORF 70: 80198-81811; ORF 71: 81804-83246; ORF 72: 83325-84362; ORF 73: 84362-84739; ORF 74: 84739-86658; ORF 75: 86658-87254; ORF 76: 87269-88336; ORF 77: 88741-89193; ORF 78: 89180-89788; ORF 79: 89805-90197; ORF 80: 90212-92326; ORF 81: 92340-93389; ORF 82: 93407-93736; ORF 83: 93720-94040; ORF 84: 94247-94843; ORF 85: 94853-95158; ORF 86: 95234-96106; ORF 87: 96314-96784; ORF 88: 96920-98263; ORF 89: 98429-99238; ORF 90: 99472-100332; ORF 91: 100660-101142; ORF 92: 101229-102500; ORF 93: 102560-103816; ORF 94: 104160-104822; ORF 95: 104950-105582; ORF 96: 105605-106117; ORF 97: 106719-107474; ORF 98: 107467-108717; ORF 99: 108731-109099; ORF 100: 109086-109397; ORF 101: 109990-110757; ORF 102: 110735-111181; ORF 103: 112416-113417; ORF 104: 113165-113623; ORF 105: 113688-114131; ORF 106: 114148-114852; ORF 107: 114914-115312; ORF 108: 115706-116176; ORF 109: 117041-117349; ORF 110: 117346-118254; ORF 111: 118272-119741; ORF 112: 120082-120477; ORF 113: 121090-121401; ORF 114: 121407-121706; ORF 115: 122253-122606; ORF 116: 122625-123011; ORF 117: 124587-124913; and ORF 118: 125811-126158.

Some of the ORFs are believed to be transcribed in the reverse direction with respect to SEQ ID No. 1 as reflected by the nucleotide numbering above (e.g. ORFs 1-33).

In one embodiment said mutation occurs within ORF 96 of the corresponding nucleotide sequence of wild-type *Staphylococcus* bacteriophage K (SEQ ID No. 1).

In one embodiment a mutation may be one or more mutation selected from C105975T, C18554T, G40894A, G78197A, G99388C, G102111A, T103720C, C105975T and/or A109329G of the corresponding nucleotide sequence of wild-type *Staphylococcus* bacteriophage K (SEQ ID No. 1).

A bacteriophage K mutant may comprise (or further comprise) an insertion at position 116111 of the corresponding nucleotide sequence of wild-type *Staphylococcus* bacteriophage K (SEQ ID No. 1). Suitably, an insertion may be an insertion of at least 9000 base pairs in length (e.g. 9547 base pairs in length).

In one embodiment a composition of the invention comprises a *Staphylococcus* bacteriophage K (mutant) comprising a nucleotide sequence having at least 70% or at least 80% sequence identity to SEQ ID No. 1. In another embodiment a composition of the invention comprises a *Staphylococcus* bacteriophage K (mutant) comprising a nucleotide sequence having at least 80% or at least 90% sequence identity to SEQ ID No. 1. Suitably a composition of the invention may comprise a *Staphylococcus* bacteriophage K (mutant) comprising a nucleotide sequence having at least 95% or at least 100% sequence identity to SEQ ID No. 1.

In one embodiment a bacteriophage composition comprises one or more (preferably at least two) bacteriophages selected from Sa87 (SEQ ID NO:2), J-Sa36 (SEQ ID NO:3), and Sa83 (SEQ ID NO:4), or mutants thereof, and a pharmaceutically acceptable carrier, diluent, excipient or combinations thereof. Suitable carriers, diluents and/or excipients may include isotonic saline solutions, such as phosphate-buffered saline.

A bacteriophage composition of the invention may be formulated as a disinfectant composition. The disinfectant composition may be in the form of a spray or liquid wash for a surface. The composition may be a hand wash. Suitably where the composition is a formulation for topical application, it may take the form of a lotion, cream, ointment, paste, gel, foam, or any other physical form as a carrier generally known for topical administration. Such thickened topical formulations are particularly advantageous because the formulations adhere to the area of the skin on which the material is placed, thus allowing a localised high concentration of bacteriophages to be introduced to the particular area to be disinfected. For example, paraffin- and lanolin-based creams, which are particularly useful for the application of product to the nasal cavity, are generally known in the art. However, other thickeners, such as polymer thickeners, may be used. The formulations may also comprise one or more of the following: water, preservatives, active surfactants, emulsifiers, anti-oxidants, or solvents.

A bacteriophage composition of the invention may be formulated for nasal, oral, parenteral, intramuscular, intravenous, subcutaneous, transdermal, ocular or aural administration. Such a bacteriophage preparation may be used directly, stored frozen in aqueous or other solution with an appropriate cryoprotectant (e.g. 10% sucrose), freeze dried and rehydrated prior to use, or rendered stable in some other formulation including (but not limited to) tablet, emulsion, ointment, or impregnated wound dressing or other item. For embodiments directed to the treatment of a pulmonary bacterial infection, the bacteriophage composition may be formulated for pulmonary delivery via nasal or oral administration (e.g. by aerosolisation of the bacteriophage composition). Thus, in one embodiment the bacteriophage composition may be comprised in a pulmonary delivery means, such as an inhaler or a respirator.

In one aspect there is provided a pulmonary delivery means (such as an inhaler or a respirator) comprising a bacteriophage composition of the invention.

The present invention further relates to the use of a bacteriophage composition herein as a medicament (e.g. for treating a *Staphylococcus aureus* infection). Thus in one aspect there is provided a bacteriophage composition of the invention for use as a medicament. Corresponding methods of treating a disease comprising administration of the bacteriophage composition to a subject are also provided.

In one aspect there is provided a bacteriophage composition of the invention for use in treating a bacterial infection. In related aspects there is provided use of a bacteriophage composition of the invention in the manufacture of a medicament for treating a bacterial infection, as well as a method of treating a bacterial infection comprising administering the bacteriophage composition to a subject.

Suitably, the bacteriophage composition finds particular use in treating a *Staphylococcus aureus* bacterial infection. In one embodiment the bacterial infection is a pulmonary bacterial infection. Suitably the pulmonary bacterial infection may comprise (or consist of) *Staphylococcus aureus*.

In one aspect the invention provides use of a bacteriophage composition of the invention in the manufacture of a medicament for use in treating a pulmonary bacterial infection in a subject, wherein the bacteriophage composition is administered to the subject, and wherein the bacterial infection comprises *Staphylococcus aureus*. In a related aspect there is provided a method of treating a pulmonary bacterial infection in a subject comprising administering the bacteriophage composition of the invention to the subject, wherein the bacterial infection comprises *Staphylococcus aureus*.

A bacteriophage composition comprising or consisting essentially of Sa87 (SEQ ID NO:2), J-Sa36 (SEQ ID NO:3), Sa83 (SEQ ID NO:4), or mutants thereof is particularly advantageous when treating a *Staphylococcus aureus* infection (e.g. pulmonary infection).

The term "treat" or "treating" as used herein encompasses prophylactic treatment (e.g. to prevent onset of a disease) as well as corrective treatment (treatment of a subject already suffering from a disease). Preferably "treat" or "treating" as used herein means corrective treatment.

A use or method of the invention typically comprises administering a bacteriophage composition described herein to a subject. As used herein, a "subject" is a mammal, such as a human or other animal. Preferably the term "subject" refers to a human subject. In one embodiment the subject is a human subject with a *Staphylococcus aureus* infection (e.g. a *Staphylococcus aureus* pulmonary infection).

A bacteriophage composition of the invention may be administered to a subject in a therapeutically effective amount or a prophylactically effective amount.

A "therapeutically effective amount" is any amount of the composition, which when administered alone or in combination to a subject for treating a bacterial infection (or a symptom thereof) is sufficient to effect such treatment of the infection, or symptom thereof.

A "prophylactically effective amount" is any amount of the composition that, when administered alone or in combination to a subject inhibits or delays the onset or reoccurrence of a bacterial infection (or a symptom thereof). In some embodiments, the prophylactically effective amount prevents the onset or reoccurrence of a bacterial infection entirely. "Inhibiting" the onset means either lessening the likelihood of a bacterial infection's onset (or symptom thereof), or preventing the onset entirely.

An appropriate dosage range is one that produces the desired therapeutic effect (e.g. wherein the composition is dosed in a therapeutically or prophylactically effective amount).

In one embodiment a bacteriophage composition is administered to a subject at a dosage of at least about $1 \times 10^7$ PFU of each phage or at least about $5 \times 10^7$ PFU of each phage. Suitably, the bacteriophage composition may be administered at a dosage of at least about $1 \times 10^8$ PFU of each phage or at least about $1 \times 10^9$ PFU of each phage. A suitable dosage range may be between about $1 \times 10^7$ PFU of each of phage to about $1 \times 10^{11}$ PFU of each of phage, preferably between about $5 \times 10^7$ PFU of each of phage to about $5 \times 10^9$ PFU of each of phage.

In some embodiments the bacteriophage composition is administered at least once, twice, three times, or four times daily. Suitably the bacteriophage composition may be administered twice daily. In one embodiment, therefore, a dosage of at least about $5 \times 10^7$ PFU of each phage is administered at least once, twice, three times, or four times daily. In another embodiment at least about $1 \times 10^8$ PFU of each phage is administered at least once, twice, three times, or four times daily. In a further embodiment at least about $1 \times 10^9$ PFU of each phage is administered at least once, twice, three times, or four times daily. Suitably a dosage range between about $1 \times 10^7$ PFU of each phage to about $1 \times 10^{11}$ PFU of each phage may be administered at least once, twice, three times, or four times daily. Preferably a dosage range between about $5 \times 10^7$ PFU of each phage to about $5 \times 10^9$ PFU of each phage may be administered at least once, twice, three times, or four times daily.

A bacteriophage composition for use as a medicament may be administered by any route selected on the basis of the condition to be treated. In one embodiment the route of administration is nasal, oral, pulmonary, parenteral, intramuscular, intravenous, subcutaneous, transdermal, ocular, aural or combinations thereof. When used in the treatment of a pulmonary bacterial infection, the bacteriophage composition may be administered nasally or orally, for example via aerosolisation using an appropriate pulmonary delivery means, such as an inhaler or respirator.

In one embodiment an antibiotic (suitably a chemical antibiotic) may be administered in combination with the bacteriophage composition of the invention. Combinatorial administration of antibiotics and bacteriophages is taught in WO 2008/110840 and WO 2005/009451, which teaching is incorporated herein by reference. The antibiotic may be administered simultaneously or sequentially with the bacteriophage composition. Suitably, the one or more antibiotics may be administered after the composition such that bacteriophage replication has become established before antibiotic treatment begins. In this case, antibiotic treatment may be delayed for one or more hours or days from application of the one or more bacteriophages. In one embodiment the antibiotic treatment may be delayed for at least 12 or 24 hours, suitably at least 48 hours. In another embodiment the antibiotic treatment may be delayed for at least 3 or 4 days, suitably at least 5 days. In another embodiment, the antibiotic treatment may be delayed for at least one week, for example at least 8, 9 or 10 days. Where a bacteriophage composition in which each phage of the composition exhibits different strain specificity is administered to a subject, it will suffice that at least one or more bacteriophage(s) is capable of targeting the bacterial infection.

Thus, in some embodiments a bacteriophage composition comprises one or more antibiotics, such as one or more chemical antibiotics. A combination of a bacteriophage composition and an antibiotic (e.g. a chemical antibiotic) may provide an enhanced (e.g. synergistic) therapeutic showing unexpectedly improved efficacy when treating a *Staphylococcus aureus* infection, particularly when used in treating a pulmonary *Staphylococcus aureus* infection.

An antibiotic may be selected based on sensitivity of a *Staphylococcus aureus* species or strain to said antibiotic. Suitably the *Staphylococcus aureus* species or strain may be the same species or strain present in a subject to be treated. In one embodiment a *Staphylococcus aureus* species or strain is taken from a subject to be treated and tested for antibiotic sensitivity. Sensitivity may be determined by in vitro sensitivity assays known in the art.

Alternatively or additionally, an antibiotic may be selected because it is known to be active against a bacteria known to be (or thought likely to be) present together with a *Staphylococcus aureus* infection to be treated (e.g. as part of a bacterial biofilm).

In one embodiment an antibiotic comprises (or consists of) a penicillin, a penicillinase-resistant penicillin, a cephalosporin, a beta-lactamase inhibitor, a tetracycline or combinations thereof, or pharmaceutically acceptable salts thereof.

In one embodiment an antibiotic comprises one or more of: vancomycin, nafcillin, oxacillin, teicoplanin, penicillin, methicillin, flucloxacillin, dicloxacillin, cefazolin, cephalothin, cephalexin, cefuroxime, clindamycin, cefazolin, amoxicillin/clavulanate, ampicillin/sulbactam, lincomycin, erythromycin, trimethoprim, sulfamethoxazole, daptomycin, linezolid, rifampin, ciprofloxacin, gentamycin, tetracycline, doxycycline, minocylcine, tigecycline or combinations thereof or pharmaceutically acceptable salts thereof. Suitably the antibiotic may be vancomycin and/or teicoplanin, or pharmaceutically acceptable salts thereof.

In one embodiment a use or method of the invention comprises:
 a. administration of a bacteriophage composition to a subject in vivo;
 b. in vitro monitoring of the sensitivity of a sample of bacterial cells from an infection (e.g. present in the subject) or from another infection by the same strain to one or more antibiotic(s); and
 c. administration of said one or more antibiotic(s), when it has been established that said sensitivity to said one or more antibiotic(s) has been induced.

In one embodiment the antibiotic (e.g. chemical antibiotic) is administered at a time period at which sensitivity of sampled bacteria to the antibiotic is induced by the composition. In some embodiments the time period may be at least 12 or 24 hours, suitably at least 48 hours. In other embodiments the bacteriophage composition and the antibiotic may be administered at intervals of one day to two months apart, preferably at intervals of one to four weeks apart, suitably at intervals of two weeks apart.

In one embodiment an antibiotic is administered at a dose of at least about 50 or about 100 mg/kg (suitably at least about 150 mg/kg) once or twice daily. Suitably an antibiotic may be administered at a dose of about 100 mg/kg once or twice daily.

In one aspect a bacteriophage composition may be used in a method of killing bacteria (e.g. *Staphylococcus aureus*) on a surface, said method comprising applying a bacteriophage composition of the invention (e.g. formulated as a disinfectant composition) to the surface. Suitably, the surface is a site of contamination or prospective site of contamination.

In one embodiment the surface is the skin of a mammal (e.g. a human), for example a nasal cavity. Alternatively or additionally, the surface may be equipment (suitably medical equipment), bedding, furniture, walls or floors (e.g. in a clinical environment).

Suitably, a bacteriophage composition may be applied to a surface at a ratio of at least 4:1, 5:1, 6:1, 7:1, 8:1, 9:1, 10:1, at least 20:1, 40:1, 50:1, at least 100:1 PFU of (suitably each) bacteriophage to colony forming units (CFU) of bacteria.

In one aspect the present invention also provides a kit comprising: a bacteriophage composition according to the invention; and instructions for use of same (e.g. in medicine). The kit may further comprise an antibiotic (e.g. a chemical antibiotic) and instructions for use of same in combination with the bacteriophage composition. The kit may also comprise means for testing antibiotic resistance, e.g. as described in the foregoing embodiments.

In one embodiment the instructions provide details for dosing a bacteriophage composition of the invention as described herein. In one embodiment the instructions included in a kit of the invention are for use of same in treating a *Staphylococcus aureus* infection, e.g. a pulmonary infection.

The invention provides in one aspect use of a bacteriophage composition or kit of the invention for a non-medical application. For example a bacteriophage composition or kit may be used in food hygiene, agriculture or crop protection, and/or in environmental hygiene applications. Thus, in one embodiment the kit comprises instructions for use of a bacteriophage composition in a non-medical application.

In one aspect there is provided a bandage or wound dressing comprising a bacteriophage composition of the invention. The wound dressing may be a pad or sticking plaster-type dressing. The bacteriophages may be applied to the wound dressing or bandage as a disinfectant formulation or topical cream, prior to applying to the wound dressing or bandage. Alternatively, the wound dressing or bandage may be soaked in a carrier containing the bacteriophages and dried to impregnate said bacteriophages within the dressing or bandage. Bacteriophages may also be adsorbed onto the surface of the bandage or wound dressing using techniques generally known in the art. The advantage of this approach is that the bandage or wound dressing allows the bacteriophages to be brought into contact with a wound which may contain the bacteria. In a related aspect, the present invention also provides methods of inhibiting the growth of and/or treating and/or killing bacteria by applying a bandage or wound dressing to a subject.

In one aspect the invention provides a method of treating a pulmonary bacterial infection in a subject comprising administering a panel of four bacteriophages to the subject, wherein the panel comprises bacteriophages Sa87 (SEQ ID NO:2), J-Sa36 (SEQ ID NO:3), J-Sa37, and Sa83 (SEQ ID NO:4), and wherein the bacterial infection comprises *Staphylococcus aureus*.

Unless defined otherwise, all technical and scientific terms used herein have the same meaning as commonly understood by one of ordinary skill in the art to which this disclosure belongs. Singleton, et al., DICTIONARY OF MICROBIOLOGY AND MOLECULAR BIOLOGY, 20 ED., John Wiley and Sons, New York (1994), and Hale & Marham, THE HARPER COLLINS DICTIONARY OF BIOLOGY, Harper Perennial, NY (1991) provide one of skill with a general dictionary of many of the terms used in this disclosure.

This disclosure is not limited by the exemplary methods and materials disclosed herein, and any methods and materials similar or equivalent to those described herein can be used in the practice or testing of embodiments of this disclosure. Numeric ranges are inclusive of the numbers defining the range. The headings provided herein are not limitations of the various aspects or embodiments of this disclosure which can be had by reference to the specification as a whole. Accordingly, the terms defined immediately below are more fully defined by reference to the specification as a whole.

Other definitions of terms may appear throughout the specification. Before the exemplary embodiments are described in more detail, it is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within this disclosure. The upper and lower limits of these smaller ranges may independently be included or excluded in the range, and each range where either, neither or both limits are included in the smaller ranges is also encompassed within this disclosure, subject to any specifically excluded limit in the stated range. Where the stated range includes one or both of the limits, ranges excluding either or both of those included limits are also included in this disclosure.

It must be noted that as used herein and in the appended claims, the singular forms "a", "an", and "the" include plural referents unless the context clearly dictates otherwise. Thus, for example, reference to "a bacteriophage composition" includes a plurality of such candidate agents and reference to "the bacteriophage" includes reference to one or more bacteriophages and equivalents thereof known to those skilled in the art, and so forth.

The publications discussed herein are provided solely for their disclosure prior to the filing date of the present application. Nothing herein is to be construed as an admission that such publications constitute prior art to the claims appended hereto.

The invention will now be described, by way of example only, with reference to the following Figures and Examples

FIGURES

Embodiments of the invention will now be described, by way of example only, with reference to the following FIGURE, in which:

FIG. 1 shows efficacy of a phage panel vs. vancomycin in a *S. aureus* pneumonia model: statistical analysis of dosage groups. Statistical analysis was performed using Tukey's multiple comparisons test (Graphpad Prism 6, La Jolla, CA). Only groups demonstrating a significant difference in the pairwise comparisons are shown (p<0.05). Where two groups are compared to a third, the p value presented is the higher of the two pairwise comparisons. **$p \leq 0.001$, *$p \leq 0.05$.

EXAMPLES

Example 1

Assembly of a Bacteriophage Panel

A composition (panel) of four bacteriophages Sa87 (SEQ ID NO:2), J-Sa36 (SEQ ID NO:3), J-Sa37 and Sa83 (SEQ ID NO:4), which together had broad activity against a panel of recent diverse *S. aureus* clinical isolates (unpublished data), was used for animal studies. In an exemplary method, phage lysates were prepared using manufacturing hosts SPS1216 and SPS1226, which do not release endogenous prophage during the production cycle. Cultures were grown in bioreactors to an $OD_{600}$ 0.2 prior to phage addition. Incubation at 37° C. was continued and absorbance read at least every 60 minutes. Cultures were harvested after bacterial lysis, and impurities separated from the phages with several filtration steps followed by chromatographic steps that enabled reduction of debris such as host cell proteins and host cell DNA. After purification, lysates were additionally concentrated using spin columns (Amicon® Ultra 15-100 kDa, Merck Millipore, Darmstadt, Germany) such that final phage titers were $\geq 1 \times 10^{11}$ PFU/mL. At the end of the process, buffer was exchanged and all material was filter-sterilized (0.22 μm filter) and stored at 2-8° C. Plaque assays were used to titer the phage stocks (Carlson, K., In E. Kutter and A. Sulakvelidze (ed.), Bacteriophages: Biology and Application, (2005) 437-494, CRC Press, Boca Raton, FL., Hyman, P., et al., *Meth. Mol. Biol.* (2009) 501:175-202). The four purified phage samples were combined such that each phage was present in the final panel at a concentration of $2 \times 10^{10}$ PFU/mL per phage and then additionally diluted 1:10 or 1:100 to obtain the 3 dosing solutions. Final endotoxin levels were <1000 EU/mL, which was acceptable for animal studies.

Example 2

Bacterial Strains

Frozen stocks of *Staphylococcus aureus* UNT109-3 and UNT144-3 (obtained from the UNT culture collection) were inoculated into Trypticase™ Soy Broth (BBL™ Laboratories)+5% defibrinated sheep blood (TSBb) and incubated for 18 hrs at 37° C. (shaking). After 18 hrs the culture was diluted 1:10 into fresh TSBb and incubated for a further 5 hrs before being diluted in fresh TSB for inoculation into the mice.

Example 3

Assessment of *S. aureus* Virulence in the Murine Pneumonia Model

The sensitivity of two *S. aureus* clinical isolates, UNT109-3 (NRS234, native valve endocarditis) and UNT144-3, that have been previously utilized in animal models of infection, was evaluated vs. the individual phage and the 4-phage panel. In some embodiments, both strains were fully sensitive to the panel as well as the individual phage Sa87 (SEQ ID NO:2), J-Sa36 (SEQ ID NO:3), and Sa83 (SEQ ID NO:4). Phages Sa87 (SEQ ID NO:2), J-Sa36 (SEQ ID NO:3), and Sa83 (SEQ ID NO:4) demonstrated improved efficacy against UNT109-3 when compared to phage J-Sa37. The virulence of the two strains was then evaluated in the murine lung infection model. Female Hsd: ICR(CD-1) mice (Harlan Laboratories, Houston, TX) were administered 150 and 100 mg/kg cyclophosphamide on day −4 and day −1 prior to infection to render them neutropenic. Groups of 5 mice were then anaesthetized by intraperitoneal (IP) injection of 0.15 mL of a mixture of ketamine HCl (100 mg/kg body weight) plus xylazine (10 mg/kg body weight). Once anaesthetized, mice were infected intranasally by placing drops on the external nares and allowing inhalation of the 50 µl inoculum. Twenty-four hours after infection, mice were euthanized by $CO_2$ inhalation and lungs processed for bacterial titers. Bacterial counts were enumerated on Brain Heart Infusion agar (Difco™ Laboratories)+0.5% activated charcoal (Sigma-Aldrich) plates for ease of recovering and detecting *S. aureus* (Barr, J. G., et al., *J. Clin. Pathol.* (1987) 40:372-376). Mice that had received 7.13 $\log_{10}$ CFU of strain UNT109-3 all succumbed to the infection prior to the 24-hour harvest, indicating unsuitable virulence. All mice infected with 6.95 $\log_{10}$ CFU of strain UNT144-3 survived until sampling, and exhibited mean $\log_{10}$ CFU/lung pair titers of 6.78±0.34 and 8.17±0.91 and 2 and 24 hours post-infection, respectively. These data indicate that the virulence of the UNT144-3 strain, both in terms of lung titers and survival, is comparable to historical results obtained for other MRSA isolates (unpublished data). Based on these results, UNT144-3 was selected for use in the efficacy studies.

Example 4

Efficacy of the 4 Phage Panel in the *S. aureus* Pneumonia Model

Six groups of 5 mice were rendered neutropenic as described above. Once anaesthetized, an inoculum of 6.98 $\log_{10}$ CFU in 50 µL of strain UNT144-3 was delivered intranasally, resulting in mean bacterial lung titers of 7.24 $\log_{10}$ CFU/lung pair at 2 hrs, which increased to 9.18 $\log_{10}$ CFU/lung pair at 24 hours in the untreated control group (FIG. 1). 100 mg/kg Vancomycin was administered as a subcutaneous injection 2 hr and 6 hr post-infection; PBS-Mg diluent was delivered intranasally at 2 hr and 6 hr post-infection to the untreated control group.

Three phage panel treatment groups were evaluated for efficacy: $2 \times 10^{10}$ PFU/mL per phage, $2 \times 10^9$ PFU/mL per phage, and $2 \times 10^8$ PFU/mL per phage. As described below, 50 µL doses of phage were administered at both 2 hr and 6 hr post-infection, such that each mouse received $1 \times 10^9$ PFU of each phage, $1 \times 10^8$ PFU of each phage, or $1 \times 10^7$ PFU of each phage at each time point, according to its dosage group. At the time of the first administration of 50 µL phage, the colony counts in the lung were 7.24 $\log_{10}$ CFU/lung pair. Thus, the multiplicity of infection was ~60, ~6 and ~0.6 for the 3 dosage groups at the 2 hr time point when the first phage dose was administered.

Administration of two doses of the phage panel resulted in *S. aureus* lung titers of 6.08, 6.16 and 7.8 $\log_{10}$ CFU/lung pair for the $1 \times 10^9$ PFU/phage, $1 \times 10^8$ PFU/phage, and $1 \times 10^7$ PFU/phage treatment groups, respectively. These correspond to 1.38-3.1 $\log_{10}$ CFU reductions compared to the 24 hr vehicle control group and 1.08-1.16 $\log_{10}$ CFU reductions for the $1 \times 10^9$ PFU/phage and $1 \times 10^8$ PFU/phage groups compared to bacterial titers at 2 hrs post-infection. FIG. 1 shows a comparison of the different treatment groups that demonstrated statistical significance as determined by ANOVA analysis (Tukey's multiple comparisons test). The $1 \times 10^9$ PFU/phage, $1 \times 10^8$ PFU/phage, treatment groups demonstrated a significant reduction in lung CFU vs the 24 hr non-treated control (P<0.0001 for both). Vancomycin administration (100 mg/kg SC at 2 and 6 hrs) resulted in 24 hour bacterial lung titers of 5.55 $\log_{10}$ CFU, similar to the two highest phage doses (no significant difference between those 3 groups was observed).

Example 5

Analysis of Colonies Resulting from Mouse Lung Homogenates after Infection

A total of 27 *S. aureus* colonies recovered from the murine lung infection model were evaluated for sensitivity to the individual phage components (Sa83 (SEQ ID NO:4), Sa87 (SEQ ID NO:2), J-Sa36 (SEQ ID NO:3), J-Sa37) and to the 4-phage panel. Colonies from the 2 hr untreated cohort appeared homogenous on the BHI-charcoal plates; thus a single colony was isolated from each of 3 different mice. In some cases, both normal and translucent colonies were observed and therefore both colony types were evaluated from 3 different mice per group (e.g., 24 hr untreated and vancomycin groups). Four colonies from each of the three *S. aureus* morphotypes seen among phage-treated groups were also evaluated (total 12): these included colonies with a typical *S. aureus* morphology as well as translucent colonies. Spot tests were performed on lawns of the 27 recovered colonies in order to assess phage sensitivity to the 4 individual phage and the phage panel using 5 µL spots of the neat, $10^{-1}$, $10^{-2}$, $10^{-3}$, and $10^{-4}$ serial phage dilutions (Carlson, K., supra, Hyman, P., supra). Testing was performed in triplicate. Susceptible control strains (SPS1216 and SPS1226) were run in parallel. Bacteria were considered sensitive if a visible clearing of the bacterial lawn, that was attributable to productive phage infection, was observed (e.g., consistent scoring or progression to individual plaques in serial dilutions). The 27 colonies demonstrated equivalent sensitivity to UNT144-3 for the phage panel as well as three individual phage Sa83 (SEQ ID NO:4), Sa87 (SEQ ID NO:2) and J-Sa36 (SEQ ID NO:3).

In this study, we demonstrated that the efficacy of a phage panel at $1 \times 10^8$ PFU/phage (MOI of each phage ~6 at the time of the first dose) and $1 \times 10^9$ PFU/phage (MOI of each phage ~60 at the time of the first dose) was comparable to vancomycin dosed at 100 mg/kg SC. Additionally, the *S. aureus* isolates that were re-isolated from infected mice remained sensitive to the phage panel. These data provide a first step in the evaluation and development of a phage therapeutic, including initial assessment of the dosing regimen.

TABLE 1

S. aureus Neutropenic Lung Model

| Group | # Mice | Test Article | Route | Dose OR Titer (BID) | CFU Assessed (Time) |
|---|---|---|---|---|---|
| 1 | 5 | Phage | IN | 1e9 PFU/phage | 24 hr |
| 2 | 5 | | | 1e8 PFU/phage | |
| 3 | 5 | | | 1e7 PFU/phage | |
| 4 | 5 | Vancomycin | SC | 100 mg/kg | 24 hr |
| 5 | 5 | Untreated | — | — | 24 hr |
| 6 | 5 | | — | — | 2 hr |

TABLE 2

Evaluation of 4 phage panel vs vancomycin

| Dose OR Titer | CFU Assessed (Time) | Mean ± SD $\log_{10}$ CFU/Lung Pair |
|---|---|---|
| 1e9 PFU/phage BID | 24 hr | 6.08 ± 1.04 |
| 1e8 PFU/phage BID | 24 hr | 6.16 ± 0.89 |
| 1e7 PFU/phage BID | 24 hr | 7.8 ± 0.45 |
| Vancomycin | 24 hr | 5.55 ± 1.1 |
| Infected, untreated | 24 hr | 9.18 ± 0.32 |
| Infected, untreated | 2 hr | 7.24 ± 0.12 |

Example 6

Assembly of a 3 Phage Bacteriophage Panel

A number of bacteriophages (including Sa87 (SEQ ID NO:2), J-Sa36 (SEQ ID NO:3), Sa83 (SEQ ID NO:4), and J-Sa37) targeting *Staphylococcus aureus* are grown on permissive host strains and then tested against a range of *S. aureus* strains by: spot testing on bacterial lawns, enumerative plaque assay and broth culture using a plate reader assay system. The plate reader monitors the optical density of a broth culture containing bacteriophages with a suitable host in a multi-well plate format. This latter method allows detailed kinetics of the infection process to be evaluated. Bacteriophages showing good plaque formation are selected.

Candidate bacteriophages are propagated in liquid (broth) culture and lysates prepared. Clarified lysates are purified by centrifugation through a sucrose cushion (27 ml of each lysate is carefully over-layered onto 5 ml of a sterile 10% w/v sucrose 'cushion', in 36 ml polypropylene tubes prior to centrifugation).

The individual bacteriophages (including Sa87 (SEQ ID NO:2), J-Sa36 (SEQ ID NO:3), Sa83 (SEQ ID NO:4), and J-Sa37) are then retested both individually at higher MOI (multiplicity of infection [ratio of infecting bacteriophage to bacterial host cells]) and as a mixture. The results of this testing are surprising, bacteriophages Sa87 (SEQ ID NO:2), J-Sa36 (SEQ ID NO:3), Sa83 (SEQ ID NO:4), J-Sa37 produce effective reduction of bacterial host numbers with very limited development of resistance when each bacteriophage is tested in isolation. However, when a mixture of all four bacteriophages (Sa87 (SEQ ID NO:2), J-Sa36 (SEQ ID NO:3), Sa83 (SEQ ID NO:4), J-Sa37) is used, development of resistant forms is more rapid than when the bacteriophages are used in isolation, indicating antagonistic effects in the mixed bacteriophage infection that permit enhanced bacterial escape.

Further testing clarifies that bacteriophage J-Sa37 appears to be antagonistic to the effects of bacteriophages Sa87 (SEQ ID NO:2), J-Sa36 (SEQ ID NO:3) and/or Sa83 (SEQ ID NO:4) in reducing the development of bacterial resistance (as is measured by optical density at OD600) illustrating the antagonistic effect of J-Sa37. An improved bacteriophage composition is provided having bacteriophages Sa87 (SEQ ID NO:2), J-Sa36 (SEQ ID NO:3) and Sa83 (SEQ ID NO:4) which demonstrates enhanced therapeutic efficacy when tested using the pneumonia model (see Examples 3-5).

Example 7

Preparation of Mutants of Sa87, J-Sa36 and Sa83

Bacteriophages Sa87 (SEQ ID NO:2), J-Sa36 (SEQ ID NO:3), and Sa83 (SEQ ID NO:4) are iteratively passaged with *S. aureus* strains using conventional techniques (see for example Kelly et al, (2011), Bioengineered Bugs, 2:1, 31-37, which is incorporated herein by reference). Escape phages capable of lysing *S. aureus* strains previously resistant are selected. Genetic mutation of said escape phages compared to bacteriophages Sa87 (SEQ ID NO:2), J-Sa36 (SEQ ID NO:3), and/or Sa83 (SEQ ID NO:4) is confirmed by genetic sequencing. The escape phages are selected for inclusion in a bacteriophage composition comprising Sa87 (SEQ ID NO:2), J-Sa36 (SEQ ID NO:3), and/or Sa83 (SEQ ID NO:4) based on the methodology of Example 6. The bacteriophage composition demonstrates similarly enhanced therapeutic efficacy to the composition having bacteriophages Sa87 (SEQ ID NO:2), J-Sa36 (SEQ ID NO:3), and Sa83 (SEQ ID NO:4) when tested using the pneumonia model (see Examples 3-5).

Sequences

SEQ ID No. 1

```
GGATTTGATTATTATGACAAATACAATACAAGCATTTTTACAAGGACAAG
AAGCAAGCACAGTTAAGGACGTAGCAACTCATGGAGTACAAAGCGGAGCA
ATTGGCAAATTAATCTACACATCAGACGTAGTAAACTTCTTTGATAGTTA
CGAGCAGGACATTGAAGCGGTCATCACTGAATACATTGAAGAGGTTACAG
GACAACAATATTATGACTTATTGAACTATGAGCTTATGAGAGACCTCGAG
AATTATGCAAATGTAGAATTTGAAGACGAAGACGAATATAATAACATTCA
ATTTGACCTAGCAGAAAACATTGCTTCTGATGAGGTTGAAGGATTTGAAG
ACATGGACGAAGCAGACCGGGCGGAAGCAATCTATGAGGCTATGGATGAT
GTTGAATTAGAACTACAAGAAACTGACAAGGTTCAATATGTTAATCTAGC
GGTTGAGATTGTAGCTCAAAGAATGGCACTATAGAAAGCACACAGAGAAG
CTTAACCGCTTCTCTAATACAATTAATCAGGAGATGTTGAAGATGAATAC
AAGACGGGTAAACAGAGCGTTAAACGAAGCAGTTAGATTATTAGATGAAC
AAATAGCAGATACTCAAAAGACTATGCAGGAGTTGAATAAACAACTAGAG
AAGCAAATAAAGGCTAAGCAAGAGCTAATGGTATTAGTTGATGTTATGAA
TGGTGATGATGAGTAATGAACATTAGAGAGGTTCACAATGTCGTTAAGAG
TGCTAAGAGCAAACTCCTGCAGGAGCAGGCTCACCCAACGGATAACCTCA
TAGAGCAGTACATCAATGATGAGCTACACAGACGCACACAGAGAAGCGGA
ACAATACAGATGAACAATAATACTACTTCATATAGTAATAGCCCATATGG
TAGCTTAGAAGAGCTTAGAGAAGCTTATGACCTATCGTCATTATCTACTG
GTGAGATTAAAGAACTAATACAAACATTTGTTTAAATTATTTTATCAAAA
```

-continued
```
CGCTTTACAATCTTTTAGTTTGTATGATATAATGAACTTAACAAATTAAA
AGAAAAGGAAATGATGAACATGACAAACTTACAAGAAAGAAAACAAGAAT
TGAAAACGTTACTATTTAACTTAGCTTTAGAGAAGAACAAAGCAACTGAT
GAGACACTGCTTAGCGTATTAGAGCAAGCACATCAAGAGGTAGGAAATCA
ATTAAGAAAAGTAAGAAAAGAAATAGAAATTTTAGTAGAAGAAAAAGAAA
GGGAATTTTGGAATGATATCGAATTTAATGGATTAGACTAAGAGGGAATA
AAATCCCTCTTTTATTTTTATCCTATTATATAATTTTTTTATATTATACG
GGGGCAGGGGTAAAATGCCACTCAATGGGGGTGGGTCTATATACCCCTAT
GGTCTACCCAGGTACTTATTTTTTGGGGAAAATTATGAAAATAAATATTT
AAAAGTCAACACCTAAAATATAGAACGTAAGTCAACACCCTATATTAAAA
GTCAACAATTTATAGTACAAATAGAGAACCTCTAAATATAAAGTCAACAT
ATCTAAAATAAGAAAGAGGGAAATTAAATCCCTCCTCTTAGGTATTATTA
ACAACCTCTAATTCATGTATAGTAATCATATCCATCCCATAGAAATCTCT
TGGGTCTCCTTTAATGAACTCTTGCTCTCCTCTATGGTTTGTTTCCTCTT
TATAACCTTCTTCTTTAATACGTTTAATTAAGTTCTCCTTATCTGTATAT
ATCTTATCTTCTCTAAAATGGAAGTTATCTTCATAAGGTTCACAATTATC
ATGTTCTACTTGGTATAGTTTCATTAGTCATTTTCCTCCTCTTCGTAAGA
CCATGTACCATATTCTGCATTATAGTGTGCTGTATCTGCGCCTTCATCTT
CATATTCTACACTATACCATGCATCCTCCTCTGTTTCTGCATCTATATAT
CTTACCTCTTCTGTAGTAATAGTACGTTTTACTTTGTATCTCTTCAACTG
TTTTTACTCCTTTATATTTTCCTCTAGTATTTGTTTTAATGTCTGACAGT
CTTTTTGGTCTAGAGTATCCCAACTCTCTAAATTTTGTAATTGGTATAGT
AACTCATTTACAATTTCATCGAAGGCTTCTGCTTTTTTATATACTTCTTC
TAGTTCTGTTTCTGCTAATTTTCTATTCCTTTTAATTTGTTCTGCTTTAG
CTACTAAGATATGGGCTTTATTCATTTCCTCTATAATAAAGTTTTTATAG
TTTTCCATTATTATTTATCCCTCCTATTTTCTATCCGTTGTTTTATCTCT
TCTCTATTGCGGTGGTGCTCCTTACTCATTTCTTTACGTTCCTTATTTGT
TAACCTTATCCTATAAACAAGGTAGTTAATGTATAAGATACCGGCTGACC
ATAGTAGCAAGAATGATATTAAATAAGTCCATGAGATACTAATTTCTATC
ATTGTGAGTCCTCCTTATATTCTTTATAGCTCTTAATGGCTATTTTACAA
ATACCTCTATTTACAGCAACAAATACTATAAATGATAATAGTGTTATAAC
TGCTCTTACATCCCCTGTAAAAGGTAATGATTGAAAGAGCAAATAGTTTT
CTAAAACACTAATAGCTGTAATAGTAGTTAGATATAATATAGATAATAAG
TAATCCTTTAATTTTAGTTTAACAAATGGTTTTTTGTGCTCACCTGTTCT
TACAATACCATAAAGTATTATGAACCACATAACAGGTACTAACTGTATAA
TAAAATCATTGTCTACATTTAATGCATGTAGAGCGTAAATAATAACTGCA
GGAATACCTATAATGAATGCTAGAAATACATAAAATATAATTAACATTAT
AGGAAGGGCTACAAGAAAACCTAGACCTTGTTTTGAATACTCTAATGTGT
TTTTACCTAGGAACTTAAAAAATGTTTTATTCATCTTCTTCCTCCTTGGA
ATTACTTTCTGTAATTGTAATTTCTAACATATATTGTAATAATCATTCT
TTTGATTGATATTATAGTTATCATTGTATTCATTAAAGTCTACATAAATA
```

-continued
```
TATTCATTTGCGTCATTTTCATAAATAATATCTATAGCTGTAATATCTGA
ATATGCTGTAATCATTTCATAAGCGTTCGTATTATCAGGATAAGCAAAAC
CAACTTGAGGTATTTCCATAGGCTTATCAATAAGAATACCGAAATAAGTA
CAGTGACGTGTTCGACTTATACTTGAAGTCCCTTTATATGTACCATAGTA
ATCTATACCTTCTGTAATACCTGATATATGGAACCTGCTTACGTCTTTAG
GCTCTAATCTTACAACATCGCAATTCTCTAATACTAAATCAATATATTTG
ATATTCATTTTAACTCTCCTTTTATATTAATAATTTTTTCCATTCTTTAT
CAACCTTTTTAAGTTCTTTTTTATTATAGTCCCCGTCTTTAGTTACTACA
GTGTTCCATTGGAACTTTTGTAATAAGCTAAAATTATTTATAATCCATAT
ATTACTTTTACTATAATACATATTGTCTTCAAATCTTATATCTTTTCTA
TAAAATATTTATATTTTATATCTTCTTTCATCTGCACCTGATATTTTA
ATAATTTCATTAGTATTTAATTGAGTGGATAACTGGAAGATAACATCTTT
TACTTTCAATAGGTCTTTAACATTACCTCTGCCTACATGGTCATTATAGC
AATCATATTTAACTTTTTTCTTTTGTTTTCTATCATTAACTACAATGAAT
ATATTATATACGATATAAGCTTTAAAATGGGTATAGGTAGTAGGTGCTTC
TGAATCATCACATTCTTTTCTTAGGTCTGTACATTGTATTTTTAATGTAA
TATTATTTGATATGTTAACTACAGTAGAGCCCTCATGTTTTTTATTAAGA
TTTATCTTATCCATTTTATAATTACCTACTTATTGTAGATACAATGTACT
CGAACATCTTCCATTACTTTGCCTAATAGATTCTGACCTTTCCAGTTACT
TTGCTCTAATATTTTAGGGTCATTTGCTTTAAGACCTACTCCCCATATTT
TATCATAAGGTGAAGCTTCTACAAAATCTTTACGTACATCTGTGTCTAAT
ATTCTTTGCTTTAGGTGTGTAGTCATAAATTTATCTTTAACTACTTCTAC
CATAATATTATATCTTACTTTATTCCACTGTTCTTCATTAAAATTACGAA
CTTTACGACCTAAACTTTTAGCATGGTTTGGGTTCTTAGCATTTAGTATT
TCACCTGCTATTTGAAAGTCATTAAAGTATCTTGCTTTGCGCCACATAAA
GGCTTGCTCTGAGTTATTAAATGTTCTTCCTTGGTGTTTAAACTTTATAG
GGTAGAAATTAGAATAAATATCCTCTTTACCCCAAAACATAATATATTCC
CTTGTTTCTCTCATAATATTTCTCCTTTAATTCCATAGTGATGGTAATAC
AATTTTAAAATTATCTAATATTTTACTTTGTACCTGTTCAAGCTCATCAT
ATTTATCCATATCAAAATCATCCATTTCTTTATGATAATATTTTATTAAG
CTTAAAATATGTTTTATCATATCTATTTGTGTTCTTTCTTTGCCGTCTAC
ATCTACAAAAGTATGGTATTCCATATCCACATGATTACTACTCTCTATAA
ATGCATTTAGGTCAGCGTATAGCTGAATAAAAAAGGACATGTCATAATTC
CAATACTTAGGTTCATTTCTACCTAGTTTTTTCTTCATTTTCTTATATTT
TTTATTCTTTTTTATCCCAAAAACTTCTTTTTCAAAGTCATTCAATTTAA
GACCTTTAAAATATTTTTTCTTCATTTCTTAACCTCCAATTTAATAAATG
GAAAATCAATGTTTCTAAATACTGCGCCAACATCACACATTAACATGTCT
CCATTAATTTCTACTTCTCCACTGTCTGTAGGGGTGTGACCACATACATA
GGTAAAACCATCTTTTCTAGGTTGAAAGTCTCTTGACCATATTAATTGGT
CAATTGTTTGTTCTTCTACAGGTTTCCAACTAACCCCACCTGAATGAGAG
```

-continued

```
AATATATACTTGTCTTCTTTATAGTACTTTCTACAATTAACCATAAGTAT
TTTAAATTTTCTATAGTCGTCTGATTCTTTAAGTTTCTTTAGTTCACTTT
TAATAAAATCATAATTATTTCTTAGATTTTCCTCTACACTACTATATTTT
AAAGTTACTGTACTCACACCGTAAGAGTTAAGTGTTTCTATACAATATCT
TGAGAGCCATTCAATATCATAGATACTTAATCGGTCTACGTTTTCCATAA
TATTATAAAACTCATCATCATGGTTCCCTAACAGAGTTACTACATTATCA
TCATTAGACATTAAATCAAATATATAGTTAACAACATCTTTTGACCTTTT
ACCTCTATCTACATAATCTCCTAAAAATACTATTGTTTCTTCAGGTTTTC
TTTCATTATTTATTTTATCCATAATTGTTAATAATTTTTGGTATTCTCCG
TGAATATCGGGAACAACGTATATAGCCATCTAATCTCCTCCTTATTGTAT
ATAACTATCTTACCATACTTAGTAAAAAAAGTCAATAAAAAAACACCTAT
TAAATTAATAGGTGTTTATCATTTAATGTATTTTAAAGTATCATTACCA
TGTGCTAATTTTTTATCATCTATTGCATGGTCATTATAAATATATTTAAC
CTCTATATACTGGTCTTCACTTTTCAGTGCATCTACTATAGAAGCATTAT
TAGTTATTGAGCTTGTTCTAGGGTAAGTAAATTTTTGACCGTCAGATAAA
ATAATAGTAACATCAACTTCAAAGTTAACAGGTAGTCTGTATCCATAATC
TTCCAAATAATTAATAAAGTTATTAAGAGAAAATGGTTTATACTTGCCAT
CTAAGGTATAGTCAATATATTCATTTAATGCATTAGTAAGTTCTGATTCT
GTTAACTCCATTGTATCATAATCTTTTCGTTATAGAATACTACAACATT
AGGTTGTTCTATACTAGAATCTCCGTCTTTATACTTAGATATAAAAAATC
CAATATTTCCTTTATGCTCTAAATAATCTGCTTTCATAATTTTAAGTACT
TCTTCTGCTATAGGTTTTGCTAATAGTGTTACCCATTCACCTTTTTCTGC
GTCATAAACACTAGGTAGTACGTTTACCATCATTTAAATCTCCTCTTCTT
AATTTATTGGTTTAAACCACAATTTACTCTTATCACTTGGTTCTGTTTCA
CTAACTACGAAAGAGTTAGAATCAATGTTTAAAGTATTAAAAACAATTTC
TTGTTTGTCTTCATTACTTTTTGTTGTAAATTCGGGAACATCTGTTAATA
TAGACTCTTTACCATTAATAGTCCATGATATTTTAAAAGACCCTTGGCTA
TACACTGTATTCGGTGTCAGTTTTTCAATTATAATTTTAGCGGATGCACC
TGTAATTTTTCTGAAGATTTTAATAATTTACCTTTGGAATCATATAAGT
TTAATGTTCTCTCCACAAATTTTATCTCCTTTACTATATTTTGTACAATT
AATATAACAAAAAAACACCTATTAGTTTAAATAGGTGTCCGACAGAGCTC
CCGTACTTAGATTACGGTTAATAATATTTTACGACAACTATATGAGACCC
TCTGTCGTTGAAACTCTTGTCACTGCGTTATTCCACAAGATATTTTAGAA
GGTAGCTTGTGGAAGAAGATTGTTTTAAAGGTACAATTAGCGTTTTAA
GCCTATTCGATACCCAGGACACTATGTCCGTACTAACTATTACGTCAATA
AAGGTTCTACGGTCTCAATTACCTACTCTTTATTGTTAAAACTAAAATTA
AGCTTGAGTGCTCTAGAAGCCAAAATCAATTAATTAACTATAGATACGGA
ATGGAGGGGCACTACCATCCGGAGTCTACGGTCAGATACAAAGCCTCTGC
CGGGCAACATACGGTATCTCTCGTACATCAGGTTGACTAGACCTTTAGAG
TTTTTCACTCCTTCTCTTATAACCAGTAACTTAAGAGAAATAGGTTTAC
TTAGTAGATATGAAACAATAAATCCACATACAATATTAAATCATAGTCAA
GTGATTGCACATATGTCTAACACCTATAAGTTTTTTGCTAGCCTGGTATA
TGGACTCTGCAGGATTCGAACCTACAGTCAAACCGTTATGAGCGGTTGGC
TTTACCTTTAAGCTAAGAGTCCTAGAAATATCCTGAGAGAGGACTCGAAC
CTCAACGACTAGGTAGCTACATCTAGCCAATGCCATTACTCAGGATTGCT
AGTAACGCTAAATAGAATTATAACGTTACCGTAGACCTTTTCTACGCTTG
GTAGATAGGTAAAATATAATGATTTCAAAGTACCCATATAGTTAGGCTCT
TATTCTCATTATAAGGTTAAAAAGGCTAACTGTGTTTAGCATTATATAAG
AGGCTTTAGTTAACTACTATACTAATAATATACCATAAATTATACTTAAT
GTCAAGTTAATTTATCAATTGAATCTATAATTTTTGATGTGCTACGTATA
TCTGCTTCTTTACTATGTTTAAGGAGATATTTTAATTTCATTAAAAAAGA
ATTTTTTTCTTTTTCTATAATATCTTCTTTATCATCATATTCTGAAAACA
TAATGAATTCTATACCTATACTATTTCTATTATGTGAAAACATATTTATA
GAAAAGGTGAATCAAAATTTTTATCATCTTTATTAATACTAAAGTCTTC
AGTAACCTGTAAGTCATTTATTTCAGATATTTCAAAGTAACCATTAACTC
TTTTAAGTTCAATATAACTATTGTATCTAAAGTAACGTTGTTCTTCTATT
AACTTCTCTTTTGTTATATAAGGATATTCATTTATGAATATAGGATTACT
TGTTCCATAGTTATCTCTAATATATTCTGCATCCTCTAGGGAATCAGTAT
AACCTAAAATTTCATAACTTGTTGTATACACTGTATCTTCTTCCCACAAG
TCATAGTCCATTTCCTCTATTTCTTCTTCTAATATATAAATTTTTTTCAT
ATATTACTCCCAAACCCCGATAAGATTTTTAAGCTTAGCTATAACCTCTT
CTTCTGTTTGATAAGAAAATACCCCTGTAATATGTTCATAGTTACCTACA
ATTTCATAATCTTGTGTACCATGTTTATCTACTAAGTATGAGTTATTCAT
AACATTTAAACTATCTTCTGAGTAACTAAAATTTATGTTATAGTCTACTA
AAAAATTAATAATATTTTCATTTACATAACCTCTCCTATCGGATATTGT
CCTAGCATTCTTGTTCCATTTTCATTATAAAAAGTATATTCTACTACAAT
AATATTCATCATATCTACATATATAGCTTCTATATACGGTGTAATATTTT
CCTCTTCTTGTATGTGTTTACCTATGATATCATATAATAATTCTGAGTGT
ATTCGTTTATCTCTCATTATAGACCTCCGTAAGGAATTCTACAGTTTTGT
CTTTCAAAGATTTTTCTACTAATTCCATAGCATCTTTATAGTGTTTGATA
TTAGATTCATTAGACTTAAGTTTATCTTTTACTTCTTGAATTAGGGGCTC
TACTTTATTAACCAAATCTTTTTTCTTTTCAATACTTACATTGCTTCTCT
TATTGTCTAATACTTCTTTTGGCATATATTTAACTTTTGCAAAGTCTTTA
TAGCTAACATTTAAGTTATCTAAATCATCTAATAAATCATTATAGTATTC
TAAATGATTATAGAATGTATAAAACTTAACAAGGTCTTTACCAGTTAATT
CTCCTTTTTTTAGTATATTATTAATATTACCGATAACAGAATATGCTATA
GGCTTAAAATTAGCTCTAACATAAGTTAAAAATATAAAATCATCATAAAA
TAAATCTAAAACAGTTTTATTGAATCTAGTATTTTTAGCTTGCTCTAATT
GAGCACATAAATTAAGAACATTATCAAACCCACTTTTTAGAACTAAAGAG
ATAAATCTTTCTACTGCATAGTATCTTGATACTTCTGTATGCTTACTTGC
TTTTTCATTATTCCTAAATATAGTATCTGATAAAGGTTGAACAACTAAAC
```

-continued

```
TCATGTAATCTTTATCTGAATGCTCATCTGATGTTCCTTGATAAGTACTT
CCAAATTCTATTGTTGATAATAAGAAACTTTTTTCTAAGTTCATTATAAC
ATCCTCCTTTTATTTGTTATTTAAATAATAACATATATTGATAATAATGT
CAATACTTATATATCTTCTTCTGTATCAACTTCATCTTGTTTATACTTAA
AGTGTTCATAGACTTTAAATAGTATAATCCCTAGTGTTATTAATCCTAAA
ATATATTTCATAGCAATCCTCCTTAATAACCATGTTTAGTTACCCACCCT
GCTAAAGCATCCATAGCTATATCATATTCTTCTTCATTTTTAATTCTTAT
AATTTTCTCTATTTCTTCCTTTGCTTGCTTAGAACTAATAAAATCAATAT
CAGTATCCTCTAGGTTAGTTAATTCTAAGTTTTCTCTAATAAAATTCTTT
TGACTTGGTGTTATAGAATTAACTCTTACATTTTCGTGATTTAGAAATTG
GTAGAAGTCCATATTACTCATCCTTTTAACGTATTCTGCCATATCTTTT
AAAATACTTAGTACATACTCTAAATCTCTATATTGGTCATCTAACGAACC
TATAATAGCATATGGTGTCATATCCCAGGCATGTGCACAGTCAAACCCTA
ATACTCTCTTACCCTCATAGTCATAATCATCGTAAGTGATACCTCTATGG
GCACGTCTTTCTAAGGAGTCATATTCTTTTCATTGATATCTGAAGGTAA
AGTTATATATCCATTTAGATGACCAGTTTCAGGGTGTCTCTTAACAGTTA
GTTTAACTCCTTTATAATAAATATCAAGACTTAAATCTTCTCCTAGAATA
TTGTTTTCTTTTTCTACTTTTTCCATAATGTATTGAGGTGCTTTTTAAA
CATAATTAGTCATCTCCTTTTTATTTATATCTTTACTATACACTATTTTT
TATATTTTGTCAACAAAAAAGGCTACTAATTAAAGTAGCCTAAATATTA
ATTATTTAGCGTTATAAGACCAACGCCAATAACCATTTTTCTGTGAGAAC
TCAAAGTGAAAACCATCATAGTCAAATTCAATATTATAGTCTCCATCTTG
AAGTGGTTTTGAATTTAGTACAGGACTATTACTCTTTGCCAATTCTGCTA
GAAACTCATGATTTACTTTTTCCATAGGGTTTATTCCTCCTAATTATTCT
TACAGTACTAATATATCATAGGTCTTTTTCTAAGTCATTTTTAAAAGTTT
CCTCGTAAGAACTAGCGTAAGTAACCTCATAACCCACTACGTTAGTATAT
CCTACATATAATGACTTATAATTAGATTTTATCTTAATATCTTCTGATTG
TTCTAGCTTATTTAAGACTTCACCTAAATCATCTGAAGAATAGTGTTCAT
TATCTATTGTTATTGTTTTACCTTGGGTATAGATATCAATTTCTTGTATC
ATCATTTCATCCTTTTGATTATTCATTATTTGATTATAAGTTTCTAAATC
ATCAATGTTATCTGTATCTGAACCTTTTACTAACCATTCTCCTCTCTTCT
TAAGGAGGTCATCAAACTTCTCATGCTCTTTAATTATCTTTTCTACCTCA
CTTGGTATTAACACAGCCCTAGCATAGTTTATATGCCACATAGACATATT
ATCAATAAGATAATTAACCATTCTTATAATCTCTTTTTCATTTGCCATAT
ACCAACCTCCTTATATCTATTACTAATATAAGAGAAAAGCAGACTTATTA
AAAGTCTGCTTCTGTACCTAATTCTAATCTTCTATTTTTCATATGAGGAA
TCATTTTTTATCTCCTGTTAATAGAGATAATTCTCTAGCTTTTTCTTTA
GATAATGTTAGTAGTCCATTATAATTATCTACTTTACTATTATATTGTCT
GACTAAGTACTCTAGTTCATCTTCTATACCTGCTAGTTCTCCTGATTTAA
CTCCAAGTAACTTTCTATACATGTCATAATCTTGAGAAAGACTTTCTACT
TTGTTTTTAGATACAGAATCATAAACTGCTTGTAAATTACCTTCTTCAAT
```

-continued

```
AAGTTTAAAATTATATTCACCAATGATTAATTCTTTTTCAGAAGAGTCAA
GGGTAACTAAACCACTTGTATTACCTGTAAAGTCACCTTTATAATCTACA
ACAATTCCTTCAGTTATTTTATCTCCTAATTCAATAGTTCCATCTTCATT
TTCTTTAAATTTATGAGCATCATAAACTTCTACTTTATCACCTAATCTCA
AATCTTGAGTTAAGTTATGTTTACCAATAATTCTATCCATTACTTAACCT
CTCCTTTATTAATAGGGTCTTGTGTTAAGAACATTTCTAAGTTCTCTTTT
GTAATAGGTAACCAAAAATATTTACTTTCCGGAATTGTAACTGTATAGAA
GTCTTCATCATTATTAACTTTGATGTTAACATCTGTAAACTCATCTTGCA
TTAACCAATGGGTTACAGTTAAGTTATATGACCCATCACTAACATATCCT
AAATCAATATCATGTCTAAAAGCCAAATCTTCTAAATGTTCTAATAAATC
GTTCTTTTCATTATGTTTTCTTCTTCTGTATTATTTTTAATTGGGTTAA
TTAATTCTGTACAAACAATATCATACAATTCACCATCTGTAACCTCATAG
TTCTTTTCAATTAATACATCTTGTATTTTATTGATTGAATTTGTAACTAC
TTTCCCATATTCTTCTTCGTAAACTTACATTTATCTAAATCAACATCTG
TAATTAATTCTGCAATCCATTTATTTAAAATTGATACTGCCATTGTTCGA
GAAATAATACTATCGTATACCATATTTATTTAATCTCCTTATTTAGGTGA
ATGTGGTCTTCTAATGAAAAATCAAAAGGCGCTACACCATTTCTTTTATT
ATTTGTTTCTTTTTTAAGTATAACATAAGTTAGTGAAAAAGTCAAGATAG
TTACTACAACCATTGATAAAAGTTTAATCAGGTTTTTCATAGTTACTCTA
ACTCCTTAAGTTTATTTTTACTTTCTCTTTATCGTACTTATAATCTTTA
CTAGAGTTTTCATTTTTTTCTTTCTCTTCTTCATTAAGTTCTCTATACTG
AGCTTCTTCTACCTCTTGTTCTTTATTATCGTTATCTTCTTCTGCTTTTT
GAATTTCTACATTCTTACTACTACCATTTACCTTTTTTCTAAAAAGAAAC
CAAAGTATTAATAAAATGATGAGTAAAATAACAATGCTCAATACAACAGC
CCAAATATTATTAGCCATTACAACCTACCTCCGAATAGTTTTTTTACAGC
TCTTAAGTTTTCAGATGAATCGTTATTTATATCAATTCCTACGCTAGAAT
CAAAAATTACAGCATTATCAAGTATATGCTCTGTTAATTTATTACCATAA
CTACTTTTACTTACCACACTACCATAACCATGATTAGTTAGGTCAACCAT
ATCAGGTTCAACTTCTAGTACTCTAAAAGATATTCTACGTAAGAATGAAG
GATTTACTAAGTAAAAGGAAGATTTAAAAACATTTAATCTTTGATAAGAA
TGTTTTATATTAACAACAAACCCTGTTAACTTATCTTCATATCCTGAATT
TGATAACTTACCTAAGTAAAGGTTTATACTATATCCTTTTGTTTCTAATG
TTTGAATAGCACTTAACATTATAGCCCCTCTGTAAGCAAGATTTTCAGGG
TCTTCCATCCAACTAATACTAGAATTATAAAATACATCAATAACTTTCTT
CTCTGCTTTAACTCTTTGCTGAGACATCATAGAATTAGGTAACCCTTTTA
TAGCATTAGGTACGTGAGGTTGATACCCTTCCGGAGCTACGACAGGTTTT
CTTTTTACTGACTTATCCATTCTAAATAATGCATCTGTCATTTTTTAAG
TTTAACTACCATATCATATGACTCTCTATCACCCTTAACCATTAAGTTAT
AGGCTTCTTGAAAACTATGAGTCCCTGTAAAATCATAGCTACCTGTATCT
GATGAATTATCTCTACCTGAAACTCTATTCTTTTTTAAAGCAGAAAAGAA
```

ATCAGGTAGACCATCATATTTAATTACATTTAATTCTGAGTTATCTATTA
ATCGTCTACCCATTGATTTTCCTCCTATTCTAATCCTAATTTATCCATAA
TTGTATCAAAGTCCATTGAATCTTTTGATGTACTATCAGATTTTCTAGGT
TCCTGCTTAGGCTCTTGTTGCATACCTAAAAGCTTTCTTGTTGCTTCTGT
GTATCTGTTACCCTCAGGTAAAGAGCTAATAAATTGATTAATCTCATCTT
TCGGTACAGATTTAAAGATAATACTTTCTACAACAAACTCATCTTCCATT
ACTCCATCTAATTTACTACCATTAATAATTGCACGCATTGAGAATACATA
AGGTAATCCTTTTTCATCATTCTCATGTCTTAATTGTTGTACAAAGTTAA
CTAGGTCTTCATTGCTTGATAACTGATGTTCCACCTTAGTATCATAGTCA
AATTCAACTTGAGCAAAGCGGTCTAATGTAGCTCCGTCTAATTGTTGTCT
ACCTACATAAATATGGTCTGCTCCTGTTCCCATAGTATTACCTGCTGACA
CAACTCTGAAATCTTCATGAGCTGTTACACGTCCAATAGGGAAGTCAAAG
TATTTATTTGCAATAGCTGAATTAAGAATTAATAGTACTTCAGGAATAGA
TGCATCCATTTCATCTAAGAAGAATAACCCACCTTTTGTAAATGCTTTAT
AGAATTGGGTTTCATGAAACTTACCATTTGCATCAATAAATCCTGTTAAT
TTAAATTCTTGAGTAATTGCATTACTGAAATAAAAATCTAAATCTAGAGC
TTCTGCTACTTGTTCTAATACATGGTTCTTACCTGAACCTGCTCCACCTT
TTAAAAATACTGGAATATTTTGGTTAACTAACTTTAGTATATCTTGGTAT
CTATAATGGAAGATTCCTGAGATATCTTTAATTGTTTTTCCTTCTTGTT
GTAATTCAATTTTAACTGGTAAATTACTAAGTTGTTCTTCTACATATTCT
TCAATTTGTTTTTTAACGTCAGTAATAATAATTTCTCTACTCTCAGTTCC
TGCTTTCTCAACAATTGCATCTACAATTGCTTGTTCATACGGATTAGAGT
TTTTCTCTCCTAGTTTGTCTGCCAAGTCTTTTGTTGTTTCCATTTGTTGT
TCTACCAATCTCTCTAATCTTTCAATAGTATCTTGCTTTGCCATATTTAT
CATTCTCCTTTGATTTGTTATACATTTATTATATTACAAGTATTTGTATT
TGTCAACAACTTTCTAAAACTTTTTTTAGTTGTTAATAAAAAAAAAATACC
TTACACCTATAACTTAACATAGGGTAAGGTAATTGTCAACACTTTTATTA
AAAATACATTAATTTAAAAAAATCATCAATATCTTTAGTTTCATGTGTAT
CCATATCATACATAAACATACAATTATATGTATGATTATTCATTATTTCT
AACATGTTATGCATAGAAGTTCCATTATTGAATTCCTCTAAATCAATAGT
TACCGTAAGTTCTTGACCTTCATAAAGTATGTTTGCTATATAATATTTCC
TAACACCTTCCATTGTTCCATGAGAAGTTTCATTATGATTAAGTAGTTCT
ACACCTAGTGAAGGTAAATATTCTGAAAAGTAATATTTACAGAAATATAT
AAAATTGTCTGTTCTTTTAGACACGAGTACTATCTCCGTACTTTATATTT
CTTTCTAATCGTACATAATATGTTTTAATTTTTTGTACTTCTTTATCTAC
TGCATCCTTTCTTCCTAACCTTGTAGTATATTTTACAATATTAAATATCA
TAGAATCAACAAAGCCATCATAAGAAAAATGTTCTTCTAGAAAAGAAATA
ACATCCTTACTACCTTTATAGTGTTCAGGTAAATGTGCATCTACTTGTAT
ATTATAATAATCTTCTAAAAGACCTATACTTTCACCAAGACTAGATAAAG
CGTAACCTAAATCATTTGAATCATTAGACCATTCTTTAGATACTGATAGT
GCATCTTCTATAATTGTTACTTTTAATTTATCTAAATAATCTTCTACTTG

AGCTTGTGTTTTCATAAATTCTTTTGCGTTCATGTAATACCCTCCTAAAT
TATATAAAAAAAACACCCTGCTTGGCTACAAGCAAGGTGAAAAGGAAA
GATATTATGGAAGTGTACTATCTAAGTACACCTCATAATATAACAGTTTT
CCTTGCTAGTTATTACTTATTTTTAAGGTCTTCTTCTTTGACAAACACT
CCATTAATAAGCTTACCTTTTCTGTCTTTTATCTCATCATAAGCCATATC
AATACACTCTTCAATATCTATATCTAACTGTAAACATAGTACTGTTAATA
CTACAAAAATATCCCCAACACTATCTCTTGTTACATGGTCATTACTTTTA
GCAATACCTGAAGCTAATTCTCCTGCTTCTTCTAATAACTTTAACATTTG
ACCTTCAGGTTTACCTGTTTGTAAATTTCTATCTTTTGCCCATTGTTTAA
TAAGTTCTACTTTTTCCATTATTCTATATCTCCTTTAATTTCTGTATCTT
TGATAATTAGGTTATGAGAGTCACTTGTTAGATTTAAATTATCTTCAACT
AATTCATGTAGATTATTAGTAATATCTTCTTCATACCTATAACCTACACG
AACATAAGCTTTAACTCTGATATCTATATTAACATAATCTTCTTGGAATT
TTTCCATTTCTAACTTCCTTTATTATATCATATTTGATACTATTGTCAA
TTAATCTGAGTAGTTTCCTTTAGCAAGTTGATACTTTTTGTGTAATTCTT
CATATAATTCTCTCATACCTTCATAGTTTCTCATATCATCTTCCAAGAAA
CTAAGGTAATCTAATAATACTTTTACATCCTCAGGTTCTAAAGTTATAAC
TGGTTTTACCATTAGGCAACCTCCTTAAATTCTTCTTTATTTATTTTCTT
GATATCTTTTTCTAATGCTTCTTTTAATTCATTAGGTAATTTATAGGCAT
CAATTGATTGTTGTTGACCTAATACATAACCATTATCTGTAATACGTATT
TCCACTGTAAACCATGAATTATCTAAATCTTCTTCTAATCTTGCTAATAA
TATTAAACAACTATTTTTTAGAATTCTGTTAGCATACCCACCAACACAAT
GAGATAACATTTTACCTTCATCTTTAAGTTTACTTACAGTATCTGCAGGA
AGGAATTTACTTTTCTACCATCTTTTAAATTTATAAGTTTTATCAATTAT
TTTTTCTAATTTATTATCATATTTAGCTTTAAGTTCTGCATCATCTAATT
GTTGTTGTATAGATTGTTTCTCATCTGTAACTATATCATGTTCTAGTTTT
AGTGAAAATGGTGTTAAACTAACACTCTCTAATGTTCTATAACCTTCTCT
TATTAATATTGATAAATCATGTAAGTAATCTAAGTAATAGTTATCTAGTG
CATATCCTGTTATACGTTGTCTGTCTTGAGCATCTACATCTAAATAGTGC
GTCATCTTTTTGTAATTAGCAAAAGATATAGATAATATTTGATTCACAAT
AGGTTTAACTTTTAAAGCATCTGTAACATCTCTTGAATCTCTAACCATTA
AAAAGGTATCGTCAAACAATTGGTGTAAATTAACTTCATTGTGTAAATGA
TTATAGTGCTTATAGAGAATATTAGCAAATCTTAAGTAATTACCTTGCTC
AAATTTATTTAAAGTTAGTAACTTTTTATAAGTCTGTTTTGTAAGATTGA
AGGCTTCATGAACTTTCCATTTAGGTTTTTTAGGTATATGGAATAGTAAT
GCATTTCTTTCAAATAACCCAAATTCTTCTAAGTTATTTATTTTATCAAT
ATTTTTAACATATCTGTTAAAGTTATTAAGTAATTAGAAGTTGAATTTT
CTCCTATAAAAATCCTATATTTATCTCCTCTATAATTTATATGACCATAA
ACATCTGTATTATCAGGACACCAACTAGAAAAATCAAAATTATGGTGCTC
TAATGTTTGTTCTATTATCTTTATTATAATTCCTCTAGTTAAGTTAGGTT

-continued

```
GTGCATAGTTTTTTAAAATAACATTTAATAAAACAGATAAAGTTAATTCA
TTCTTATATTCACTTTTACTAATATCATCTTTATATAGGTTTAAAGTTAT
TTCTTTATTAACAAGACTATCTGTTAAGAAAACCTTAACTTCTCCTGTTT
TAACGTCAAATGAACTTTTATTTTCTAAAACCCATTTGTTACCCATATTA
TGTTTATCTCTAATATGTTTAACTTTAAGACCAAAAGATGAATAGTTTTC
AGTACTTGGATGCATGTACCAAACACGGCTATATAATTCATCTGTCATAG
CACTATAGTACTCACTAGAACCTTTTTCTATATCTTCATTCATAACAATA
ATAGATGACTTTATAAGACCATATTTACCTTGGTCTAGTACATCCATAAT
ATCATTATTTAAACTATCTACTACTTTTTTATATTCTTCTAATTGTCTAG
ATTCATTCCTCCATAAATGGTCATTACCTTCTAGTTCTTTAATTTTTTCT
TCAACATAACCTTTTGATTGTATACGTCTTCTACTCTTATCACCATATAC
AGGAAAATCTTTTCTTTCTTCTCTATTAGATTCAATATACTCTTTGTAAC
TTCTTCCTTTATTATCATCAACTACACCTTCAACTAATTTTTCAACTGTT
TCATAAGGGTTACCTTCAAAGTTTGTTACTTCTTTATTACCACATAGGGC
TAAAAATAAATGTATTTCTGTGGCTGTATCAAAACTAAATATATTATGAA
TATCTCTAAATAATTCTTTAGAACCTAAGTTAATTATATTATTTTTCTTT
TTCTTAAGAAATACATCTTCTTCTCCTATATAGATACATCCTTTATTAAC
CTTAGGTAAATTAATAATTTCTTGTTCTGTTAATCCTTTTTGTTTATAAG
TTATTGCCATTTAAAATCACTCCTTATTTGTTATGTACTAATCATACCAT
AGTAAATAATATTTGTCAACAAAAAAGAAGAACTTTTTAAAGTCCTTCT
AAATGAGTTTCGTATATAACTTTTGAATTTTATTTAATGGTTCTAAATC
TAAATTCATAATAAGTTTTTTATACTTTCTTGAATTTTTAAAATTGATAG
TATTTGGCATAGCAAGAGCTTCATCAACATCTTTAGTATAGCTTACAACA
TCTGAATAGATATCTACTTCTTTTACATATAGACCTTGAGTTAAACTCCT
AAATACTACCTCATTATGTGCTATAACTTCTTCTTTCTTTTCTATGCTCA
TTTATAAACCTCCTGGTCTACTCTACACAAACAAGTACGTATTCTAAATT
AGTTAAAGAAACTGATTTAATATTGTTTAATTCTTGTAATTTCTTAATTT
CCACATCATAGTTCTTACTTATAGTCCATAATGTCTCTCCTGCTCTTACT
TTGTGATAATATTTATTTCCCTCTTTGATAAGGTCATTCAATATTACCTA
CCCCCTTGAGTAATAATTAGCTTGTAGATAACATATAAGTATAAGAACAA
AGTTACAAATTCAGTAGCTATAATATGAACATAGGTATGTGTTAAAACC
ATACTTACAATTAATGAAGCTAATCCTAATCCAATAATAAGAAATAGAAA
TCTATTTGTTCCTTCTGCACTTTTAGTTTTATAAAAGGTTGTTATCTGAG
TTAGATACGCAAGGATAATAGTAATAGTTGCTACAGTTTGTGTTAAGGCT
GTAAAGTCACTTAATAAAAATAGTAACAGTGAGAACACAATAATAAAAGG
TATAGAGAAATAGTCCTTTTTTCTATATGAAGCTACTAATAAGCAAACAA
TACCTAAGGTTAAATTAAGACCTACAGATACTATTTGAAATACTGAAGCA
TCAGTTAATAATAAGTTGTAAAAACTTATACCTACTGTAGCTACAATTAA
ATACCAAAAATAGTTACTAACTCCCTTGACACTTTCTGCTTTAACTAATG
CTACTAAACCTGGTATATATCCTACTGTAATTAATATAGCATATAATATA
CTTAAGTAATGTGATAAATTATCCATCTTGTTCCCCTAATTTCTCTAATC
```

-continued

```
TATTAATAACTTCTTCCCATGAAATAAATCCTTCTCCGTCTGTTAGTTCT
AAAACCATACCATACACAAATTGGTTCGTACTAAATTCAGCTCTGTCAGG
GTGATTGTATGGTTTACCATGTCCTTGTCTAATATCCGAGCAGTAGATTA
ATACGGGTTTATTTACAATGTTTTCAAGTTTATCTACTATTAATTCTTCT
TCAGTATTTAATGACGTTTCAAACTTATTTGTAAAATAATTAAAATACTC
TTCTCCATTATCATATATATGGTTAATTGTTTCTTCTGCTTGATGTTTCA
TACCTAATAAAATACCGAGTTCTGCAATTGTTCCTAATCCTTCATTAAGG
ATATCAAATACAAAAATATCTGATTCTTGCATAGCCTTAAAGTCATTAGT
TAAAATACGTTCTGCTAGCTTAGTTTGTTCTGCATTAGCTTTATCATTTA
TTGACTTATCTTTGTGAGGGCTATAAGGAGTTACTCCTACAATGCCATCT
ACTTCTTTATGTTGTTTATCTCTGTAATCTACCATAGCTTCATTTAGGAT
ATGTCCACCCATATAAATTACTTTGTCTTTAATTTTATTACCGATCTATA
GTATCTCCTTTTTCTTCTAAAATTTCTCTTAAAATATGTGGCATTTTTTT
CTTAATTTGTTTATCTACTATTTTCAGTATATTTTCTTTTTCTTCTTCCA
TAATATCATCAACAAAGTTTTGACCTACTTGTTTCATAATTAGACCGAAG
TTTTCTAATTCTAAATCATCTTCAGATAATCTATCTTCTTCTATAGCCCT
AAAAATCATTTTTTCCATTCTTGCTCTTGTAATGGCATAATCTGCCACTG
ACTCGTTCTTTTTACTTCTGTTTTCATTTTTTGACGACTAAATTCTTTA
AACTCATTAGATACTAATTTAAAGTAGTCATCATATTCTGATTTACCATC
TAAGTATTTAATTACTATACCTTCACCCTTATCAGGTTTAACTGTCATGT
CAGATTTTCCTACTAATTCTTGAATTTCTTCAGGTTTTAAATCATTTAAG
TAGTGAGATGGTTTAGATACTAGCAAAGTTTTAACTGTTTTTAACCCTAA
ATGATGTGCAATTACATTCATGTCTTCTACTGATAAATAAACTTCATTTT
CTTTATCATAAACATCAAATACATAAAAATTGTTGTAAAATTCTTCTTTG
TACTGAATCTTATGTTTGACTAACCATTCACCAAAAATAATGTATTTTTC
TAAGGCTGATACGTACGTATTTCTTACATTTATATTTTCATGTACCCAAT
CATAAAAACCATTTAAAGTTTCATTCTCATTTAATTTTTTTCTACGTGAA
AAACATACTAATTCACCATTTTCTACTGTGAAGCTTGCATTACTTCCATC
TAATTTTTCTTGTACAACTAGACCTCTTTCTTTAAATTTATCTAGTACAA
TACCTTTATTTTTTACTTTAGTATACGATTTCATTAATTATCCTCCTTTG
AATTATGTACTATAGAAAACAAAATAAGACTTACGCTTGCTAAAAATGCT
AATACTACTAAACCAGGTAAATTTAAAACTGTTGATAAGAATAATGATAT
TGCACTTATAACATAAACTAGACCGCTTAGAAATAAAGTTAATAATACAA
TTGTTATAAGTTTCACCAACCAATTGTTATTAATAAATACCTTAGCTAAA
TAATTCATAAAAAAATCCTCCTTAGTTATTATAGAATAATTATACCATAA
CTAAGGGGATTTGTCAACATATTATTTTACCATTTAAAATTATCTGCATA
TTGTGCAAGCTTAGAGCGGAAATTAACTGTAAAATTATGAAATACTGCTC
CTTCATAATTTTTAAAGTATTCCATATAATCTCCAAAACCTGATTTACTT
TCGTTCTTTAAATCTATTTGTTTAAAATTACCTTCTACTATTACAGTAGA
ATTTTTTGTATGAACCCTTGTAAGAACTTTTTTAAGTTCACTACGTTTAA
```

-continued

```
AGTTCTGTGCTTCATTTATAATTATAGTAGCATCTCTTAGATTTCCACCT
CTTAGGAATAGATGGGATATTTGAGATACCCAACAATCTCCTAGTTTATC
TTCTTTAACATTATCTTCCATCATTAACATTTCAGTTATTTGTTGTTCAG
GATTCATATTAAGTTCAATAAGGGCATCATGTAATCCCATGAAATAAGCC
ATTTCTTTTTCTGTCTGATTACCTGGTCTGCTTCCTAAATCTTCTGATAC
TGGTGAAATTATAAATACTAGCTTTCTATTTTTATTAAGATAGTCTGCGT
AAGCACAGGCTACTGAGCACATTGTTTTACCTGTACCGGCTTGACTCTCA
TTCCAAAGTATTTCAACATTATCATTAAAGAAATCCTCACAGAAATCTAA
CTGCTCGGTTGTAGCTTTTTCAAGGAATTCATTAAAGACTAGATGTTCTC
CCATGTTGTATCTTACATTAGGATAATCTTTTAACTTAAAGTCTAACTCT
TTTAGTTGTATTGCCATATTTTAAAGTTCCCCTATCTATAAATAGTTTTA
CTCTCTTTTAATATAGTACTAATTTCCGATATATTCTCCTGTTGAAGAGC
AATAATTACTACATTCACATTCAGGGTAGTTATCACAAACATCTTCATCT
TCTACATCATCATAACCAATATCATAATTATTATAATTAAAATCTACAAT
ACAATTTTCACTATTACCTTTAGATAATCCTGTATAAATAATATCATCCA
CAGAATCCCAATCGTTATCTGCCAAGTAATTTACACTATCTAGTACTGAT
TCATTATCAGGTAAATAAATACTACCGTCTGAAAATTTAATTAAAATATC
ACCTTGAGGTAAGGTATCATTAATTAAATCAATCTCTGTTTCTTCTTCAA
TAGTGAATACAGTTCCTTCTAATCTTTCCGGTGTAGTATGTGTTAAATGT
TTTACAGTATCCCCTGATTCTTCATAGAATCCTACTGCATTCATATCTTT
ATTATATTTTGCAATAAATTTACCATTGTCACTTACCAAATATTGACTAG
TTGCATTATAGTCGTTTGCGTCATCTACTGTCATGCAAGGGTTATAATCT
TTAACATAATAACTAATTTTCCTAACATCTGCTGTTTGTACTTTCTTACC
TTCACCTTTAATTACTGAATTAATTTTCTTCATAATATTTTCTCCTTTTT
ATATATCAATTGATTTTTTGCAAGATTATCGGCATAGTCATTCCATTTG
TCATTTGAATGGCTCTTTACTTTTACAAAGTTTATATCTATTACTTTTTG
GTATTCTCGTATCATATTAATATATGTTTTACTTAGAATATTTCTTGCAG
ACCAAGTACCTTCATACCAATGTATTAAACCAATATAATCTATATAAACT
ATTGCCTGATTGTATCCTAGTTTTATAGCCTCTTCAATACCATAACAACA
AGCCAATATTTCACCTGCAACATTATTATACTTTATTAATCCTGGTTTGT
CAACACTTTTACTAATTTCCGATATTATATTTCCTTCTTTACTTACCAAG
ACAGCACCTGAGCCTACTTTACCTTTATTATATGAGGAGCTACCGTCTGT
GTATATATTTACACTATCCTGCATACTTATAATCCTCCATAAATTGAGGG
AATTCACAATCTGAATAGACTTCTCTGCAAAAGATACTGAGATATAGTT
AAAATCAAAACATTTGAAACAGTGTTCTTGAACTTCTTTTTTATCTTTAG
CAATCACATTAAATTTAAAACCATCAGCTATTACTGTAAATACTCCTTTT
TTCATAAAACAAATACCTCCACTAATTTTATTTAAATTAATAACTAACT
CAATAAATGATTTAATAGTTTTATTTTTACCTTCATCAATATCTGAAAAG
AAATTAATTAAACTGTCATCCTCATCAAATAAATCTTCAACATCATCAAA
TTTATTTAATATGTCTGTAACACTGTAACCCTCTTCTGATATATACTCAT
GTAAGTCTTCTCCATCTTCTGACAGTGTTGCTTCTATTTTACCATTTTTA
```

-continued

```
CTTTCAATTAAATATAAAGTATTTAACACTTTAACAGAATCTACAACTAC
ACTGTAGTTACTAATAGTAGGATACTCTGTATAAAGTATTTCTACATTAG
TATTCATATAACTATCAATTACAGAGTTAACTGTATCTCTTTTTAGCTCA
GATACATTATGTTTTCGTATAGTAGGAAATTCTTCATCATATTCTACTAA
TTCTTTTCTATCTGTATTCAATAACTTGTCTAAAGAGGACAACAATACTA
TTTTATATTGGTTATCAGGAAGACTGTCTGTAATTTCCATTATTGTTAAA
AACGTATCTTCACCTAGAACTTTGTTTATATCTTGTAATTCAAATGAATC
TACCATTTCAATAGTATCATCTATATCATCTGTAGTCATTAAAAAATTAA
CTAAATTATTATTCTCCATCGTCTTCCTCCAATTCTTTAAATAACTCTTT
TCCTGGAGTATTTAACGCTTTCTCTAACCGCATTAAATTAGCACTTCTTG
GTTTCTTTTTTCCATACTCCCAATAAGATATAAGAGAGTAATGAACACCT
ATCTCAGAAGCTAGACTTCTTAACGTATGTCCTTTTTCTACTCTAATTTT
TTGAAGGTTTAGAGGTTTACTTTCCTTTTTTTCATCCATAATTATTTCTC
CTCTACTTTTAAAAATTTAAAATCCTCAGATGCTTTTGCATTTTTTAGTA
TATACTCTTGTGATTTATTTCTTGCCTCTGCCTTACTTTTAGCATATAAC
TCTATATGAAATACATGAGGTTTTTTTAAAGACGGTGACTCGTATCTCCA
ATAAACTTTAAAAAGTAGTGTTTCTTTTTTTAAAACATTAATTCGAAACC
ATCTTTTAAATTTATTCATTCATTATCCTCCTCTATTTATTTGTTAAACT
AATTATAGCATAGTTAACTTATGAAGTCAACTATAATATACAAAAAAAGA
CTAAGAAATTAATCTTAGTCTTAATATATTAATAACTATTATGTGCGTTG
TGGTATGCAAGAGCTCCTGATGTTGAACCGTAACGGTCAATCATATATTG
TTTTTGCACCTTTAGTTTGTTCTGCTATAGAACCACCACTCCATGATTTAC
CTAATCCTTGGAATAATCCTTGAGCTCCTGATGATGCATTAACAGCATTA
GGGTTCATTGTAGATTCACGCATAGCAATTTCAATCATTGCCTCGTCTCC
ACCTGCTTGTCTAATCTGTTCTGCTACAGAGCCTCCTGTAGAACTAGTTG
ATTGTGTAGGTTGTTTAGTTTCCTTTTGAACTGGTGCTGATGTTGTTTGT
ACTTCTTTTTTAGTATCTTGTTTATTTTGAGTATCAAATTGTGCTTGTTG
TTGGTCTACTTTTTGTTCAGGTGTTTGTTCTTCTCCTGCTAATCTAGATA
CTGTATTATCTACTTGAGTTGAGCCTGAATGGTATTCATAACCAAAGTTA
CCATTATAATTATAGAAATGATAAGTAAATTCACCATCACTAAAAGAGAA
ATCATAATTACCTGCTTGAATTGGTTTTGTATTTACTTCTGCTGAATTTG
ATTTAGCTTGTTCTGCTAACTTATTATAATCAATTTCGTCTGCACTAGCT
TCATTTGTAGCAATACCTCCAAAAGTAATAGCTGTACCTAATGCTAATGT
TGCAAAATTGTTTTCTTCATAAATTTAAAACTCCTTAAATAATTTTTTA
GAATTGTTATTTGTAAACCGACATAAGTAATCATAACATATATCTTTAA
ATAACGCAAGTATAATATAGCACTAATTAGTGTAATATTATTAAGGTTTT
ATTACAAACATTACAGTTATCAGATAATTAAATACAAAAAAAGAGAGGTA
ATTATATTTACCACTCTCCAGTTTCATTATATTTATTTATTACATTATCT
CTTAATTCTATAGCCTCTTCTAAAGATTTTGCACTAAAATATTTAACTTT
ATTTTTTCTTACAATTTGTATATTATATACATTATTTGATTTTTTGTATA
```

-continued

```
TATTATGTGTACTTTTCTTTCTTATATTAGTTGAGTTTTCAGACCAGTA
GACCACTTAACATTACCAGGTTCATAATTACCATCATTATTTATTCTATC
TATTTGATAATTTTCATTCGGAGGGTCTCCCATATAGTCGTAGAATTTTT
TAAAATCATTCTTCCATTCTTCACATATTTCTATACCCCTTCCTCCATAG
TTTTTATAATTTATAGCGTTAACATCGTAACAACGCTGTTTCATACCTAA
CCATCTTTGGTACATTGGGTTACTGGATAATCCATGGGTAGTATTCCTTT
CTCTCATTAACTCACTATGAATTTTATTACTCTCACACCCACAAGATTTT
ATTTTACCTTGCCTTAAAGTGGAGCTTCTAACTATTATTACTTCTCCGCA
TTCACATAAACATTCATACATTTTACATCTTGATTTATCCCTCTTACTAG
ACTCTTTTATAACTTTTAGTTTATTAATAGTTTCTCCAATCATAATATCT
CCTCCTATAATAAAACTATAGCATAAAAAACCACCTATGTCAATAGGTGG
TTAAACATATTATTTATTTAAGTTTGTAATAACACTATCTGAACCTATAC
TAATAGGTTGTTTTCCATTCCATTTTTCAATTAATTGTTGTTGTAAAACT
TCCTCTGTTAAGGATTCACTTCTAATGTCATTGGCTTTCTTTTCACCTTT
TGCTTCAATTTCTTTCTTTTTAGCGTTTTCTTCTGCTATTTGCTTATCAA
CTTTAGTGCGCTCTAGTTCTTGGTTTGCTTTTACTCTCTCATCAATTGCT
TTTTGAGTATTTTTATCTGCAGTTGGGCTTGATAATGCAATATCATCAAT
AATAAAACCTTGCTTTTCTAAATTATCATTAAGTTTATTTAAAGTATCTT
GTTTAATTTCTCCTGTTTTTACACCAAAAGCATCAATTACAGAGTACTTA
GAAATTGCTTGTCTAACATTATCTTGTACTCTAGAACGAAGATACCCTTT
TTCAAGTTCTTCTATGTCAGCACTTCCGAATCTATTAAAAAGGTTTACTG
CCTTAGTTGCATCTACTTTATAAGATACATCAATGTCTAATTTAATATTT
TTACCATCTGAAGTTGCTACATTTAAATCTTTATATTTATGTGTTTGTGT
TTTAGTTGGGTATTTATTTACCTTATCAAAAGGTGCTGTTAAATGCCAAC
CCGGTGATTTAGTATCTTCCTTAACACCATTTACTGAGTATACAACTCCA
ACATGACCTTGTGGAATCTTAGTAATACACATTAATAAAATAATAAACCC
TATAATTGCTAAAAACCCTAATACTCCTGAAATAACTACTGACTTTCTCA
TTACATTTCTCCTTTTTCTATTTCTTTTATTAAGCTATTTAAAGCTTTTT
CCTCTTGGTCTATTTCTTGTTTATCGGCTCTAGTTACAATTGATTGTCTA
CGGTCATTTAAGAATTGTTTTTATACTTTACATATTGTTCTAAACCGTA
TTCATCTAATGTACCTTGCCTAACTAATTCCCTGTATTGTTTTCTTATGT
TACTCTTCTTCTCTTTCATTGAAAGAAAATCAAATAAATAACTTATACCA
AAACCTACAAGGACTAGAAAAACAATAAAAATAGCAAAATATGTTAAAAG
TAGTGCCATGTAATTCCTCCTTTATTTGATTACATATATAACTATACACT
ATGTATTTAATTTTGTCAACACTTTTTTGCAAAAAAAATAGACGGATTTT
AAATCCGTCTAAATTTATATTCTATTTGAATACTCCCCAGGCAACGCCAG
GTATTTGATTAGGTGGAACACCTTGACAAGTTCTAACAGGGCAATATACT
CTGTTACCGTTGTAAGCATTATAACCTATCCAAATGTGACCTGCTTGGAT
ACAAACTTCGTCATATACAATTGTAGCCCCTGCCGGTAAGTTACCGCCTA
CTGGAGCATTTAAGAATGGAGAACCTATTCTAGTTACTATAGGTTGGTTA
CCATTGACAAATGTTGCATTTTCCGGTTTATACCAAGTTCCGTACTGGTT
```

-continued

```
CTTTTTCCAAGAACCTGTAACTGGTCTAGTTGCCGGTGTACTTGCGCTAC
TTGTTTTACCATCTTTAACTACTGTAGAACTTGAAGTTCCTTTATCCATG
TAGTTTTTAATTTGTTTAATGAAATAATCTTTTAATTTATTCATTATTGC
TTGTGATGGTCTTCCTTGTGTTACTGGATTAAATCCTGTATGAAGAACCA
TAGAACGGTGAGGACAGGCAGTTGGTACAAATTCCATATGCAATCTTACA
GTTTTACGGTTAGGAGTAAGACCCGATTCTTTAAATTTCTCTGCTGTAAA
TTGGAATACTGCTTGTTCATTTTTAAGGAATTGAGCATCACTAGCACTCA
TTGATTGACAGACTTCAATACCTGCAAATCTAAAGTTACCTGAGTTTGCT
CCTGTTCCATCCGATTATTCAATAAAAGACGTAACTCCTTTACCGGTTCT
CTTATGAACTCCTTATAGTTTCCTATAAGACTAGACTATATCTTCACCCT
AATTTTGTTAGGGGTTCTCCATTTCGATTTAAGGGATTCTCACCCACTCC
ATTAACTTGAGCCCTACTCCTATTGACGATTTATTTTTATTGGCACTCGT
CCGAGGGATAGTCGTTGAACCTTAATATTGTTTCCAAATGTATCCGTAGG
CTGTTTTTCTCTCTCCTTTGATACATCTTCCTATATTACCACTTCTTTTA
TTAGAAATACCTAAGAACTCTAAAGCCTCTTGAGCTGTGTAAAAGACATT
CAATAAATTACCTTCTAAGTCATAGTGAGCTATATTATAATTTATTTCAT
TTTTTAATCCTGTCTTTATTGCATGTTCTCTGTTCTCGGAATTAGAAACC
CATTCTAAATTTCCTACACTATTATCATTTTTACCATTTAAATGGTTAAC
TTGTTCTTTATTATCAGGATTAGGTATAAAAGCCATAGCAACTAAACGAT
GTATTTAGGTGAATGGTATCGTAACCTTACAAACAAGTAACCCTTGTTA
TTTTTTTGAAGTTTTAACTTTTTAGGCTCTTTACCTTTATAAGATATTAC
TTCTCCTTTATCAGTAATAGTGTAATTTTCATATATTTCTAATCCAGGTA
TTTCATTTAATTTCTTTTCCATAATAACATCTCCTTTACTTAAGTATATA
GGAAAGTTATTATGTTGTCAAGTAGTTTTTTAAAACAATATTCTTGGATG
CTGATTAGCATAGCTTGATAGCCTTAGCCTCCCAGTCAATTAAAAGAACT
TTCATTATACATTACTGTATAACAGGGCAATTTATTTACCCGTGTGCCAA
GCAATTTGATTCTTAGCATCTATTGCTTCCCATACATAACCTTCAGAGCC
GTAGTAATGAGCAATACCATTAGCGTATCTAGCATAACCTGCATTAGCTA
ATGAATTCTCGTATTGTTGTCCTGAAGAACGACCTGCATCGTTGTGTATT
ACCATTCCTTCAGGTTTTTTACCACGTTTATCCATTGTATAGTTAATGTG
ATTCTTAGAAACTTTTAGTGTTGCTTTCTTTTTAGGTGCAGGCGTTTTAC
TTGCGCTTTTCTTAGCTGTTTCTTTTTTAACAGTAGTTCCTGCTTTTACA
GGTATTTCAATGAAGTGAGTTAATCCGTAATAATTATCTACACGTTTTGT
AGGTTTTTTATTAGCATAACCATTCCAGTTTTGCTCTAAAATAGTAAATG
TAGAAGTATTACCTCCATCATATACAATACCTATGTGACCCCACTGTTCA
TAACTACCGGATGTAAATACCGCAATCCAACCTTTTTTAGGTACAGTAGA
AGGTTTATTTTCATGTATTTTAAATCCAGTACCATAACTCTGTTTAATTT
GGTCTTTAGCATTACCCCAAGTTCTAACTTTATTATCTGTTAACCATAAA
ACATAGTCTGTAATAAGGTCTTGACACTGAGCGTGATAGTAACCATCTGC
ATCAATGGCTCCTGCTTCCATTACACCAAATGATGGGTCATAACTTGTAG
```

-continued

```
CTTTTTTAACTCTGTAAGGGCTATCTACTGTTCCTTTTGCATAAGCATCT
AAACGTTTATTTATTTCTGCTTGAGTCTTAGCCATTACTTAACTTCCTCC
TCTGCAAATACTTTACCATGTTCCTCGGTATCTTCTTCATCTTGAGAAGG
TGCTGAACCACCATCAATTTCATCTTCAATAGCAGGTACTTCATCACTAT
CATCTGTGTCAGGTTCTGCATTGTTTTCGTAGCTGTCTATCTCAAAAGTA
CTAGTGTTATTTGCATTTGCTTGCCATTGAACGAATTCATTAGGGTCTTT
ACTATCACGAGGTTTAAGATAGTCTGTTTGAACAATATCACTATCTTTAA
GACCTTTAGTATTATTATCAACAATAATACCTAAACCTGCTAATAGTGTT
AGTATAGAACCTACAATATTTACACCTTGCTCAATTTGAGCTGAGTAGTC
TAAACCGAAAGCACCTATAATTTGGTTAGCAAATAATGCTACTGCTGATA
TAATTGCTACCCAAAATGTTTTGCTCTTAGTTCTTGTGCTAAGGTTTATT
CCTCCAACAACTTTAGGTTGTTTAGTTTCATTAGCCATTAAAAAACCGAC
CTTTCTATTATATTTATTTCTAACAATAATATAACAGTAGGTCGGTCATG
TTTATCTATATTAATTTAACACTTACTCATTAATTTGGTTTAGTTTTTTG
ATAACTTCAGACATTTGTTTGTTATCTAAATCTTCTAATTTAGTTTCAGG
AAGTAGCTCTAACTTATCCCAAACTTCTTCTTTATTAGATACTTTATTAT
TAATAATTGCCTTACCAACTAAACTTTCCGTATAATATAATTGTTTTGCT
GATGCCATTTGTATCTCTCCTTTTAAATATGTAAAGTATATAGCTAGTAT
CGTATCCTAGGAACAAAACTTGCGCTATATACTCAATGAAATCCTACCC
TCATTCGAGGACACAGCAAACCGGTTCGTCAACCGCACATATGAATTCTC
AGATTTCATTTATGTAAAACACACCCTCTTTGATTTGCACAAAGACTAAG
GGTTTTGGAGACCCTTGTACTACTAATTATACTAAGGGTGTTTATTATGG
TTTCTATTGGATTTGAACCAATGACACCTAGAGCTTCAATCTAGTGCTCT
ACCATCTGAGCTAAGAAACCTTAAAACGACCCATACGAGACTCGAACTCG
TACTCTCTGCCGTGACAGGGCAGTGTGTTAACCAGTTACACCAATGAGCC
AAAATTATAATGCTATACCCTAACCTTACCTTAATGTATAGCAGGTTTTT
ATATAAGCTCGAAGCAACGATTATTACCACTCATAACAACTATATATTAA
GTGAAAGGAGGTGAAATGAACAAAACGTGGTAATTGGTACTTATATAGGA
AATATGTATAATCTACAAGGAGTAAGTTATTGGTTCATAAAGGAGTGTGA
ACAATAAATACATGAAAGAGTGAAAGTTTACTCCCTGTAGATTCTTTTTT
TAATTATCAATCAAAGGAGGAAACTGATAATTGTTAATAATAAACTATAA
AGAGGAAAATATTTATAGTCACATTCTGATATAATGCAACTAAATATCCA
AGCATAACCCGTCTCACGAGGAACCTACCTATAAGACCTGTTATTAAGTG
AATCACTACGATTGACTCTATTAAGGAGCTACCTTAAGTCCATCTCACGC
AATTTAAAAGGGACTTACAAACCGTAAAACGGTAATAAGTTTATTAAATA
ATGTGATATTAACATATTAGTTAATAACTTTCACATGGTCGAAGAAAAGT
AAATTTATTTGATTACCAAATTATTTTTATCAAATATAGCTCTTTTGAAC
CTGTAGATTTATGCTACTTATACTGATAACCTCTATTATCTAACACATTT
CTGTGCTCCAACTACAGTTAGTCGTTACAGCGTATCTTTCTAGGATTCCG
CTAAGACCCTAAAAAGAAATTAAACCCTAGCCGTTATCATACTCTACAGA
CCTTATAAGTAAGTACCAAGTATACCAATCGTATTTAACAATACTAATGA
CGACCCATCCTACCGATATATCTCCGATAGGTTTTGATTCGTTTGATTAT
CTTGTACCTTATGACTACCAAATCATTATTCAGTCACTATGCTCAGATAT
TTAGTTGTATTATTTATATATTAATTATAACATAATTTTTATTACTTGTC
AAGTTAATTTCAAAAAAATTATAGAAGTAGGGACGTTTACCTACTTCTAT
TTAATTTACACAAGGATGATAACATTGTTATTGTTTTATACTGGAAAACA
ATGTAATAAAACAGTGATGTGTAAGGTATTTGTTTTATTGTTAATTATA
TTATAGCATATACTGATACCTTTGTCAAGTTAATTTAATACTTTTTTTAA
AACATTAGTTATCTTTTGTTAGTTCCTCCTGAATAGCATCCCATCTTCTT
TCTGCTTCACTACGATTATCTTCTATATGTTTTGTAGTTTTACAACATTT
GATACAATATATATCTTTGATATGACCTTCTTCTCTTTTATTTGCTCTTT
TTCTTGGTACTTTGAATACATTTCCACATTCTTTACATATTAAACTTGAG
TAAAACATTTTTTGTCTTTTCATAATTAATCAATTCCTTTTCTCTTTTAT
TTGATAATTTAACTATATACTATATTGATAAATAAGTCAACAGTTTTCTA
AAAATAATTTAAATTATTTTGAAGAATACTTTAATATCAAGGGTTACAAG
AGAAAAGTACGTATTTAGAAAATAAGGAGTACTCCTATTATATATAATT
ATATTCTGATATAGAGTAATAAATAATATTAAATATATAATTATAATTAA
TAAGGTTGGGAAAATTGATATAAACATAACTGATACTGCTTATAGATACT
CAGTATAAAAGTAAAATCCCTTAGTATCAGTACTTACAGGCAAAAAAGTA
CGTATTTAGAAAATAAGGAGCTCTCCTATTATAGTTATATATATTTATTA
CTATTATTAATTACTATTTAAATATATAATTATAATTAACAATGTTAGAA
AGTCAACAATAGTATAAATAAAAAAGTGACTACTTAAAGTCACTCAATAA
TTAGAATACTATTTTAAAAGATTCTATTCTGTTTGGATTAATATATACTT
GAGGTGAAGTTATAGCACTTTCAGTATATACTTTTATAGAGGTTTCATCC
ATTCCTCTTAACATATAATCTATATCTTGCCTATTGTAACTCTTTTCATC
AGTAGATACTAAAAAGTATTTAGCTCCACTTGACATTGTTATTTCAATAT
GTTTTGACATCTACAATCTCTCCTATGCAAATTTGTTAAAGACAAAGGAT
AATATAGCTCCTAGAACAAGTAAAAGAACCTTCTCAGTTGTATCCTTTTT
CTTAGTATCCTTAGTTTTTGTACTTTCAGCAAGTTCTGAAATCTTTTCAT
CAAGTCTTTCTAATTGGACGTAAATTGCTGATTGTTTTTCACTATTGACA
GCTACATCTTTATCTATACTAACTATCATTTTTCTTAGTTCAGCTACCTC
AACTTCTAAATCTTTGAAAGTTCCTCTATCTATATAATTACCTTCTTGTA
TCTTAGACTTAATAGTTTCTACTTGAGAAACAAGGTTGTTTATCTCCTTA
TCCAACTAGAATCACCTCTAAGGTCTAACCGTTTCAGATTCAGAATGGAT
ATCATAATTTTCTAAGAAATCATTGATAATCTCCATATAATTATCCGTAA
CGACTTTTCCGTAAGATGTTTTTGTATCAATTTCAAACCTAAGCTTACCA
AAACTTTGGAGGTCTAATTCTTTTATTACAATATTAGGGTCATCAGAAGG
AAGGTAATAATAGTCGAAGTATATAATTGAGCCATTTATTAATACTCTGT
CTATTCTATAGACGTGGAAATAGCGTCTGTCTCTTTTAAAATGGGCTAGT
GCATCTTTAAACTCTAACTTAAGGATATCCTTATATTTAGTCAAAGTGGT
AACCTCCTTACTATTAATTTTTAAATTTACTTATTTTGTGGTATAATAGT
```

-continued

```
TATGATAAAGGCAGTTATTATAATTATATTAAGAATAATGATAATAATTA
TTTTTTCTGAGAAAATAAGCCAAATACTAAAAACAGATAAAGCATAGATA
GCTGATAGATATACTATATTAAGAGTTACCTTACTTTTATCTTTTCTATA
GATAGAATAACCTAAAGACGTTGTAACACCACTAAGTATAAAATAATAGA
AACAAAAAAGAGGTATAGACAGAAAAAAAGATACGATAATCATTGTTAAA
CACCTATTTCTTTTTGACCTATTATTTCTAGAACTTTTAGATTACACCAC
TAATATAACATTAAAAGCCAGTCATAAAAGTCAATTGTTAGATTAATAAT
ATAATAAAAAAAGACAATAGGAGGTTAAAGTGGTTGAATAATAACATAGC
TATATTCATATTCAAAACACTGGTTATCATTATATTCTTACTACTAATTT
TGTCTGTTATTAATTCCTTGTCCCTTATTTACTCAATAAGACCGAGTGTA
GTTATGACATACTTTATCTTTGGTGGTATTGTTTCTAATGTCGCACTTAC
TGTAACAGATAAGTTCTTACTGAAGAAAGAAGACCCCCTACCTGAATATG
TTCTTAAAAAAGTAGAGATAAATGATAAAGAAATAAGAATAATCAAGAAA
ATAATAGAAAGTAATTATGGTATAACAGCAGAAGAGATAAAAGTTAGGGC
TAAAGCACAAAGAAGAGTAGAGGAAGATAGTAAAAAGGAAGATTACAATG
AAAACAAAGAAAGAAATTAAAGAACAAAGGAAAGAACTTAAGGATGGTGC
TACATCTGTTTCTTTAGTAAAAAAGGGAGATAAGAGAATAGCTAGCCCTA
GTAGAATTTGTAGTCTATGTGGTCAGCAGTTATCAGGTATGAATTACACT
AAAGGAAAAGCATTATCAAAAGTTAATCATTTTCATTTACAGTATTCTAA
GTATATTTATTTTGATATTTGCGCAGATATCAACAATTGTTATAAAAATT
TAAGAAAACGAGGTGAAATGGATTGAGTGCAGAAAATATTAGAGATATAA
TTAACAAGAAAAAGTTAGAAGAAGAGGATACAAGAAAATATATAGCTGAT
GGGTTTATGAATGGTATCGGTAAATTAATGTACGAATTTAATAAGAAAGT
AGATAACAAAGAAATAGAAGTTAAAGACCCGAATGATTTATACAAATTAT
TTGTGATATTCTCTCAAATGCAAAATATGGTCAATGAAACTTCTGAAGGA
GGAGCAATACCTCAACTATCTAGACCTCAACAGGAATTATTTGATGAGAT
TACAACAGAAGATAGTAATGGAGAATCTACAGTTGATTTACAGAAGATAT
CAGAAATGTCAGCGGAAGATATTACAGCAATGATTTCTGAAAAGGAAAAA
GTAATGAATGAGGAAAATTCAGAAACATTCTAAGGAGAAAGATATAAATG
GATGGAAAAGAACTAATTAAGATAGCACAAGAAACATTTCAAACTGAAAA
AATAACAAGAGAACAGATAGACCATATAATCAATATGCTAAATCCTTCTA
CCTATATGCTTAAGTATCATACACTGAGAGGGCATCCTATAACTTTTAGT
ATTCCTAATAGAGATAGAAGTAAAGCACAGGCTCATAGACCTTGGCAAAC
TAGGATTGTAAATGATACTCATCCTAATAAGGCTGTAATAAAATCACGTC
AGTTAGGTCTTAGTGAAATGGGTGTAATGGAAATGGTTCATTTTGCAGAT
ATGCATAGTTATGCTAATGCAAAGTGTCTGTATACATTCCCTACAAACGA
ACAAATGAAAAATTTGTTCAGTCACGTTTGAACCCTGTTTTAGAGAAAG
AATATTTTAGAGACATTGTTGATTGGGATAAAGACTCGTTAGGTTTTAAA
AAGATAAGAAACTCTAGTTTATTCTTTAGAACAAGTTCTAAAGCAAGTAC
TGTAGAGGGTGTGGATATTGACTATTTATCTTTAGATGAGTATGAGAGGG
TAAAGTTATTAGCAGAATCGTCTGCATTAGAATCAATGTCTTCATCACCT
```

-continued

```
TTTAAGATTGTGAGAAGATGGAGCACACCTTCTGTACCTGGGATGGGTAT
ACACAAATTATACCAACAATCAGACCAGTGGTATTACGGTCATAGATGTC
AACATTGTGATTACTTAAATGAAATGAGTTATAATGATTACAACCCTGAT
AATCTTGAAGAAAGTGGAAATATGTTATGTGTTAATCCTGAAGGTGTAGA
TGAGCAAGCTAAAACAGTACAGAATGGCAGTTACCAATTTGTTTGTCAAA
AATGTGGTAAACCACTAGATAGATGGTATAATGGTGAGTGGCATTGTAAG
TACCCTGAGCGTACAAAAGGTAATAAAGGGGTACGAGGATACCTAATAAC
ACAAATGAACGCTGTATGGATTTCTGCTGATGAATTAAAAGAGAAAGAAA
TGAATACAGAATCTAAGCAAGCATTCTACAACTATATTTTAGGTTATCCT
TTTGAAGATGTTAAACTTAGAGTTAATGAAGAAGATGTTTATGGTAACAA
ATCACCTATTGCAGAAACACAATTAATGAAACGAGATAGATATTCTCATA
TAGCTATTGGTATAGATTGGGGAAATACTCACTGGATAACTGTTCATGGT
ATGTTACCTAATGGTAAGGTAGACTTAATACGATTATTCTCTGTTAAAAA
AATGACAAGACCTGATTTAGTTGAAGCAGATTTAGAAAAAATAAATTTGGG
AAATATCTAAGTACGACCCTGATATTATAATTGCAGATAACGGGGACTCA
GGTAATAATGTTTTAAAACTCATTAATCATTTTGGAAAAGATAAAGTATT
TGGATGTACTTATAAATCTTCTCCTAAATCTACCGGACAATTAAGACCTG
AATTTAATGAGAACAATAATAGGGTTACAGTGGATAAATTAATGCAGAAT
AAAAGATATGTACAAGCACTTAAGACAAAGGATATAAGTGTTTATAGTAC
AGTAGATGATGATTTAAAAACTTTCTTAAAACATTGGCAGAATGTTGTTA
TTATGGATGAAGAAGATGAAAAAACTGGAGAAATGTACCAAGTTATCAAA
CGTAAAGGTGACGACCACTATGCACAAGCAAGTGTCTACGCCTATATAGG
ATTAACAAGAATAAAAGAACTTCTTAAAGAAGGAAACGGTACAAGCTTTG
GTTCTACATTTGTTTCTACTGATTACAATCAAGAAGGAAATAAACAATTC
TACTTTGATGAATAGAGGTGAAATAGACTTGACAGATAAATTATTTTATG
GTACAATTAGTAATGAAGAATTAATAAAAGTGTATTGAATTTGTTATTG
GGTGAGGAATTATCCTTAGATTATGTTTCTAAAAATAGTGATACTTTAGA
TGTTAAATATGAACATGTTTATAAATCTCTAGGATTCGATAATTTCTTTG
ATTGTTTTTTATATGCTAATAGAGAGCCTGAAATAGTCCATAAAGGTGGA
GATAAAAATCTTGGTGGACTAAATAAGGTTAAACGTACTGTTATTCGTAA
TGGTAAAGAAATGGAAATGACAGTTTACGAAGATGGTAATAAAGAGAACG
ATAGTAAAGAAAACAAGAAGGAAAAGAAGAAGTTAGTAGAAGTGCAGTA
GGAGCAAGGGCTATTTCTAATGGTGAAGAAGGAAAGGTAAACCCTAAAAA
GGTAGCAAATTCATTATCTAATTTAAGTAAAAAAGGTGTAGATGTATCAC
ATATTAATACAAACTCATCATTGTATAAAGAGTTTGTTGATGATAACGGT
GATACATTAGCAATTACATCTTTTAAACGAACTGAAAATGATATAATATT
AGAATCTTATGCAAGTTCACATGATTCAGATGGTGTAGGAGCAAGAGCTA
TTATGGAATTATTACGTTTAAGTATTAAGGAAAATAAAAATGCAGTTGTG
TATGATATAGAATTACCTGAAGCAGTAGAGTATTTAAAAACTTTAGGATT
TAAACCTAATAAAGATGGATACATCTTAAGAAAAAAAGATGTAAAACAAT
```

```
TCTTAGGTGATTATAGTGATTTTATTTAGCACTATAGTCATCTATTCTAT
TGTATTTATTCTATATATTGTATTAAAAACAATTTATATAAAGTCTAATA
TGAGTAGAATAGATAACACAACTGAATTATTAAAAATATTACAGGAAGAT
ATTGAAGGTAAGATAAAAAAGGAAGGAAGAAATAAATGACTTTAGAAGAA
AATAAATTAACATTAGAAGAATCAATAACTCCACTTAGCAAAGAGGAGAA
AGAAGATAGTATTAAAGAATTTAGCAGTTTATTATGTGAAATGGTAAATA
GACTATATAAGTCTTATAATGTATTTAGACAAGACCCTATGGATGAAACT
CAACGTCTAGATGGCTCTTTAATGGTCTTTCAAAGTAGATTAAATGACCC
TTTAACAGGAGATTTACATGATAAGATGTATAAACTTGCTTTTTCAAAAC
GTATTGATATTTTCGAAGCTAATAAGCAATTTAGAAAAGATGTAGAAGCA
GGTAAAGCAATTGAGTTAGGTGATGTAGCTATTATAGATACAGCATTAAG
TAACATCCTTTCAGGCAATGAGTTCCAAGGAAGTATTTCATTTATGCTTA
GAAAAGACTTTGAAGAAAAGAACGAATTAGAAAAGAAGAAGAAGAGAAA
CTTAATAACTTATAAAAGGGAAGAATTATGAGACTATATAAAATGAGGTA
TCATAATTGAAAAAGAAACCACAAGGCAATGAGGTAATCATAACCATAAT
AACGGTTATGATAGCAGTATTTGTAGTCATTATGACCATATTTTTTAATA
AATATCAAGATGCTAAAGAAGATAAAGATAGATATCAAAGATTAGTAGAG
ATTTATAAAAAGCAGATGATAATGATGGTGAGACTAAAAAGAAATATGT
TAAAAGATTAAATAAGGCTGAAGAAGAACTTAAAAAAGTAAAAAAGAAA
CAAATTATAAAGATTATAATAAGAAGTCAAGTAAAGAAAGACAAAAAGAA
GATAAAGAAACTAGAGAGAAATATATGATGTAACTGGTGATGATGACTT
AATATTAGTAAAAAATAATATTGAGTTTAGTGATAAAGTAGACAAGCCCG
AAATACTTATTAGTGAAGATGGAATTGGTACGATAACTGTTCCTGTAGAT
AGTGGGTATGAAAAACAAACAGTAGGTTCTATTATTACTAGTGTATTAGG
TTCTCCTTTCCTATCACCTGGTTCAAATAGTATAGATGGTTTAAGTGTTA
TTAACGATAATGTTTATCCAAATACAGTAGATAGCATAGTAGAAGATACA
AAACCTTCTATTAACTTACCAACGGATAATCCTATTATAACAAATCCAGT
TGAACCAACTATACCTTCAGATATTATACCTCCTATTGATAATCCTTCAG
TTCCGATATCTCCTGAGAACCCAGGAGATAATAATCAAGGAAATACAGAT
AATCCAAATCCTCCCCCTCCAGGGTACACAGATGAAGATGGTGGAAGAGG
CTCCGGTGGTGGAGGAAATTCTGAACCACCATCAACGGAAGAACCTTCGG
ATAATGGTAACACCGGAGGAGGAGATTGGGAAGAAAAACCTGACCCAGGA
GAAGAACCTTCAGATAATGGTAATACAGGAGGAAATGGTGGAGAAGTTAC
GCCTGAACCTGAACCTGAACCTGAACCTGAACCTGAACCTGAACCTGAAC
CTGAACCATCTGAACCGTCTGACAATCCTGATGAAAATGGAGGATGGGAA
ACTGAACCAACTGAACCTGAGTCACCTTCAGAGCCGGACGATAAAGTGGA
CGAAGAAGATAAAAATGAAGATACTACAGATGATAAACAGCCCACTGAAC
AACCGGACGATAACAACATAGATAATGAAGATAAAACTGAAGAGGAGTAA
TTACTCCTCTTTTTTGTTTGCTATATTAAATAAGAGCTAAATATAAAAAA
ATTGAACATTACGGTGGTGAAAACTTTGTTAGGAATGAATATTATAACGT
CACTATCAGTAGTATTTACTTGTTTAAGTCTTTTAACTTTAATGATTTTT
GTTCATAGTAAGTTCTCTAGTAAAAACGTTTTTGTTTTGTATGTAATTTA
TGCTATAATAGGAATAGGTACATACATAGTTTTAACTATGTTTCAAACAA
CATCTGTACTTATTAAGAATGATGTAATAGATTCCATAGAAATACTGAA
CATTATATTGGATTCAATGACCCTATAATTATATTTACTATAAGTTTTAT
AGGTGCAATACTTGGAGGAATTTGGTACAAGATGATGAAAATTATTAAAA
AGAGTAACTTTAAAGATAAAAAATAAAAAAGACGGTGAATAGGTTGATAT
TCTCTAAAGATAAAAAATGGGATGAAGCAAAAGATTTCATCAAAGGTCAA
GGTATGCAAGATAATTGGATAGAGATTGTAGATTATTATAGACAGATAGG
TGGAAAACACGTAGCTGTTTTTATTGCTTTAAACAAAGTAAAATACATGA
TTCTAGAAGCAACAAAAGACAATAAGGTAATATTAGTAGATAAAGATAAT
AATATACTATTAGAAGATTATGATATTGTTATGGAAAGTAAGAAGATGTT
TTATTACATTGAAGAACCGTTCGAGGTTAAAATAAATATCCCTCAACATA
TTAGAGATGTAACTTATAATAATACTGTTGTATTAACTACAGTAAGAGGG
AGTAGAGGTGACTAGTAATTGGCAGATTTATTTAAGCAATTCAGATTAGG
TAAAGACTATGGTAATAATAGTACCATTGCTCAAGTTCCTATTGATGAAG
GATTACAAGCTAACATTAAAAAAATAGAACAAGACAATAAAGAGTATCAA
GATTTAACTAAGTCTTTATACGGACAGCAACAGGCTTATGCAGAGCCATT
TATAGAAATGATGGATACGAATCCTGAATTTAGAGATAAGAGAAGTTACA
TGAAGAACGAACATAACTTACATGATGTTTTGAAAAAGTTTGGTAATAAC
CCTATCCTTAATGCTATCATACTTACACGTTCAAATCAAGTAGCTATGTA
TTGTCAACCTGCAAGATATTCAGAGAAAGGTTTAGGTTTTGAGGTAAGAT
TAAGAGACCTAGATGCGGAACCCGGTAGAAAAGAAAAAGAAGAAATGAAA
CGTATAGAAGATTTTATTGTTAATACAGGTAAAGATAAAGATGTAGATAG
AGATTCATTTCAAACTTTCTGTAAGAAAATTGTTAGAGATACTTACATCT
ATGACCAAGTTAACTTTGAAAAAGTATTTAATAAGAATAATAAAACTAAA
TTAGAAAAATTCATAGCAGTAGACCCTTCTACTATTTTTTATGCAACAGA
TAAAAAAGGTAAAATTATTAAGGGTGGTAAGAGATTTGTTCAAGTAGTAG
ATAAAAGAGTAGTAGCTAGTTTTACTTCTAGAGAGTTAGCTATGGGTATA
AGAAACCCTAGAACTGAATTATCTTCTTCAGGATATGGATTATCAGAAGT
AGAGATAGCTATGAAAGAGTTTATTGCCTACAATAACACTGAATCATTTA
ATGATAGATTCTTCTCCCACGGTGGTACTACTAGAGGTATTTTACAGATA
CGTTCAGACCAACAACAATCACAACATGCATTAGAGAACTTTAAGCGTGA
ATGGAAATCTAGTTTATCAGGTATCAACGGTTCATGGCAAATACCAGTGG
TAATGGCAGATGATATTAAATTTGTCAATATGACACCAACTGCTAATGAT
ATGCAATTTGAGAAATGGTTAAATTACCTTATCAATATTATATCTGCTTT
ATATGGTATTGACCCTGCAGAATTGGTTTCCCTAATAGAGGAGGAGCTA
CAGGTTCTAAAGGTGGTTCTACTTTAAATGAGGCTGACCCGGGTAAAAAA
CAACAACAATCTCAAAATAAAGGTTTACAACCTTTACTTAGATTTATTGA
AGACTTAGTTAATAGACATATTTATATCAGAATATGGAGATAAGTATACAT
TCCAATTCGTAGGTGGAGATACTAAGAGTGCTACTGATAAACTTAATATT
```

```
CTTAAACTAGAGACTCAAATATTTAAAACAGTTAATGAGGCTAGAGAAGA
GCAAGGTAAGAAACCTATTGAAGGTGGAGACATTATTCTAGATGCTTCAT
TCTTACAAGGAACAGCCCAATTACAACAAGATAAACAATATAATGATGGT
AAACAAAAAGAACGTTTACAAATGATGATGAGTTTACTAGAAGGAGACAA
TGATGATTCTGAAGAAGGGCAATCAACAGATTCTAGTAATGATGATAAAG
AGATAGGAACAGATGCACAAATAAAAGGTGACGATAATGTTTATCGTACT
CAAACATCTAATAAAGGTCAAGGAAGAAAAGGAGAAAAATCTTCTGACTT
TAAACATTAATTAATAAGCCTAGAATAAATCTAGGCTTTGTTTATTTTTT
TCGTAATTTAATTTTGATAAATGTAATAACTATGATATACTATATGTAAT
TGATATTAATACATAAAAAATATTAATATTTCACTTACAAGTTATTATTG
TTATATTATTAACGTAAAAGTAAATAAAATAACAAGTGGAGGTGTAGACA
CCTTTGGAAGAAATAAAATTTAATGCTTTTGTACCTATGGATTTGAAGAA
ATCTGTATCAACAGCTTCTGATACTAATGAGTATTCTATCGTTTCAGGAT
GGGCTAGTACTCCAAGTATGGATTTACAGAATGATATAGTTAATCCTAAA
GGAATAGATATAGAGTATTTTAAGTCACAAGGGTACATTAATTATGAGCA
TCAAAGTGATAAAGTTGTAGGTATACCTACAGAGAATTGCTATGTGGATA
TAGAAAAAGGTTTATTTATTGAAGCAAAGCTATGGAAGAATGACGAAAAT
GTTGTTAAGATGCTTGATTTAGCTGAGAAATTAGAAAAATCAGGTAGTGG
AAGACGTTTAGGTTTTTCTATTGAAGGTGCAGTTAAAAAACGTAATATAA
ATGACAATCGAGTTATTGATGAAGTTATGATAACCGGAGTTGCATTAGTT
AAAAACCCTGCTAATCCTGAAGCAACATGGGAAAGCTTTATGAAATCATT
TTTAACTGGTCATGGTACATCACCTGACACTCAAGTTGATGCAGGAGCTT
TAAGAAAAGAAGAAATAGCATCTAGCATTACAAATTTAGCTTACGTCACT
AAGATTAAAGATTTAAAAGAGTTTAATGATGTATGGAATGGCGTTGTTGA
AGATTTGAGTAAATCTAATAGTATGGGATATGAGGAATCAGTCCTTACGT
TACAACTAGCTAAAGGTTTATCTCGTAAAGATGCAGAACTAGCAGTAATG
GATATAAACAAACAAAAACTAGAATAGGTAAGGAGAATACATTCTATGAG
TAAAGAAATGCAAAATATTTTAGAAGAGTATGATAAGTTAAATGCTCAAG
AGGCAGTTTCGAAATCTGTAGAAGATGATGAAAAGAATACAGTAGAATCT
ACCGAAGAGCAAGTAGCAGAAACAACTGAAGAACCTGCTAAAGAACCTGA
AAAAGTATCTGAGGAAGATGCTAAAGAAGCACAAGAGCAAGGTGAAAAAG
TTGAATCTGAAGAGGTAGCAGAAGGCAATGAAGATGAGGAAGTTGAAAAA
TCAGCTAAAGAATCAAAAGACCCTGTAGACCAAAAAGATACTAAGACAGA
AAATAAAGACAACGAGAAACGTAAAAATAAAAAAGATAAAAAAGAAGATT
CTGACGATGAAGATAAAGATACTGACGATGATAAAGATAAGAAAGAAGAT
AAGAAGGAAAAAACTTCTAAATCAATTTCTGATGAAGATATCACAACAGT
ATTTAAATCTATCTTAACATCTTTTGAAAACTTAAATAAAGAGAAAGAAA
ACTTTGCTACTAAAGAAGATTTAAGTGAAGTTAGTAAATCTATTAATGAG
TTATCAGCAAAAATTTCTGAAATCCAAGCTGAAGATGTTTCTAAATCAGT
AGACACTGATGAAGAAGCTGTAGAAAAATCAGTAACATCTACAAACGGAG
AGCAAGAAAAAGTAGAAGGTTACGTTTCTAAATCAGTAGACACTGAAGAA

CAAGCTGAAACTGGTGAAGCAAAATCAGAAGAAGCTGAAGAAGTACAAGA
AGATAACACATTTAAAGGATTAAGTCAAGAAGAACGAACTAAGTTCATGG
ATTCTTACAAAGCACAAGCTAAAGACCCTAGAGCTTCTAAACATGACTTA
CAATCAGCTTACCAATCTTACTTGAACATTAACACTGACCCTACTAATGC
ATCAGAGAAAGATATTAAAACTGTAAAAGACTTTGCACAAATTTAATTAA
TGCACAAAGTTGTGTTATATTATACGGTGTAACTAAAGAATATAAATAGG
GTACATTTTACTGTACCCTACATAAAATAAAAAGAACACAAATGAAAGGT
GATAAATTTATATGACTATCGAAAAGAACCTGTCAGACGTTCAACAAAAG
TACGCTGACCAATTCCAAGAAGACGTAGTAAAGTCATTCCAAACTGGTTA
TGGAATCACTCCTGATACACAAATTGACGCAGGAGCTTTACGTAGAGAAA
TTTTAGATGACCAAATCACAATGTTAACATGGACTAATGAAGACTTAATC
TTCTATCGTGATATCTCACGCCGTCCTGCTCAATCTACAGTAGTAAAATA
CGACCAATATTTACGTCATGGTAACGTAGGTCACTCTCGTTTCGTTAAAG
AAATCGGAGTAGCACCAGTATCTGACCCAAATATCCGTCAAAAAACTGTA
TCAATGAAATACGTTTCTGATACTAAAAATATGTCAATTGCATCAGGTTT
AGTAAATAACATTGCTGACCCATCACAAATCCTTACAGAAGATGCTATCG
CAGTTGTTGCAAAAACAATTGAGTGGGCTTCATTCTACGGTGACGCTTCA
TTAACTTCTGAAGTTGAAGGTGAAGGTCTAGAGTTTGATGGTTTAGCTAA
ATTAATTGACAAAAATAACGTAATTAACGCTAAAGGTAATCAATTAACTG
AGAAACACTTAAATGAGGCGGCGGTACGTATCGGTAAAGGTTTCGGTACA
GCTACAGATGCTTACATGCCTATCGGTGTACACGCAGACTTCGTTAACTC
AATCTTAGGTCGTCAAATGCAATTAATGCAAGACAACAGCGGTAACGTTA
ACACTGGTTACAGCGTAAATGGTTTCTACTCATCTCGTGGATTCATTAAA
TTACATGGTTCTACAGTAATGGAAAATGAACTAATCTTAGATGAATCATT
ACAACCATTACCAAATGCTCCACAACCTGCTAAAGTTACAGCTACTGTTG
AAACTAAGCAAAAAGGTGCTTTTGAAAATGAAGAAGACCGTGCAGGATTA
TCATATAAAGTAGTAGTTAACTCAGATGACGCTCAATCAGCTCCTTCTGA
AGAAGTAACAGCTACAGTATCTAACGTAGACGATGGTGTTAAACTTTCAA
TTAATGTTAACGCTATGTACCAACAACAACCACAATTCGTTTCTATCTAC
CGTCAAGGTAAAGAAACAGGTATGTACTTCCTAATCAAACGTGTACCAGT
TAAAGATGCACAAGAAGACGAACAATCGTATTCGTAGATAAGAACGAAA
CATTGCCTGAAACAGCAGACGTATTTGTTGGTGAAATGTCACCACAAGTA
GTTCACTTATTCGAATTACTTCCAATGATGAAATTACCATTAGCTCAAAT
TAATGCTTCTATTACATTTGCAGTATTATGGTATGGTGCATTAGCATTAC
GTGCTCCTAAAAAATGGGCTCGTATTAAAAACGTTCGTTATATCGCAGTT
TAATAGAATAAGAAAACTGAATACAAGAGAATAGGGATAAACTTAGGGT
TTATCCCTTTTTTATTAAAATAAACTTGAAGGGATTTAATAAATATGTTA
TACTATAAGAAACTATTAGATAAAAAAATGGCTACTGTTTATGGTACAGT
GGAGATTGACAAAGATGGAGTAGTCAAAGGATTAACTAAAGAACAAGAAA
AAGAATTTGCCAATGTTCCAGGTTTTGAATTTGAAGAAGAAAAGAAAACT
```

```
ACTAGAAAACAATCAGCTTCTACTAGTAAAGAAGAAGAGCCTAAGGAAGA

GGAAAAGAAAGCCTCTACTAGAAAAACTACAAATACTACTAGAAAATCTA

CAGCACGTAAAACAACAGCCAAAAAAGATGAAAATAAGTAAAGGGTGAAT

TAAATGGTTAACTCAATGTTTGGAGGGGACTTAGACCCTTATGAAAAATC

ATTAAACTATGAATATCCTTATCATCCTAGTGGTAATCCTAAACACATAG

ATGTAAGTGAGATAGATAATTTAACATTAGCTGATTATGGATGGTCACCG

GATGCAGTTAAAGCATATATGTTCGGTATTGTAGTTCAAAATCCTGATAC

AGGACAGCCTATGGGTGACGAGTTCTATAACCATATATTGGAAAGAGCGG

TAGGTAAAGCTGAAAGAGCATTAGATATATCTATACTACCTGACACTCAA

CATGAGATGAGAGATTATCATGAGACAGAGTTTAATAGTTACATGTTTGT

ACATGCTTACAGAAAACCTATATTACAGGTAGAGAACTTACAGCTACAGT

TTAATGGTAGACCTATATATAAATACCCTGCTAACTGGTGGAAAGTAGAG

CATCTAGCAGGACATGTTCAATTATTCCCTACAGCACTTATGCAAACAGG

ACAATCAATGTCATACGATGCAGTATTCAATGGATACCCTCAATTAGCAG

GTGTATACCCACCATCAGGAGCAACATTTGCACCTCAAATGATACGATTA

GAATATGTATCAGGTATGCTTCCACGTAAAAAAGCAGGAAGAAATAAACC

TTGGGAAATGCCCCCTGAGTTAGAACAGTTAGTTATAAAATATGCATTGA

AGAAATATACCAAGTATGGGGTAACTTAATTATTGGTGCCGGTATTGCT

AATAAAACATTAGAAGTAGACGGTATTACAGAGACAATAGGTACTACTCA

ATCAGCTATGTATGGTGGAGCTAGTGCTCAGATACTTCAAATAAATGAAG

ATATAAAAGAACTATTAGATGGTTTAAGAGCTTACTTTGGATATAATATG

ATAGGATTATAAGGAGGGTTAGAAAATGGAAAAACCGTATATGATAGGAG

CTAACTCTAACCCTAATGTTATTAATAAGTCAACAACATATACTACTACA

ACACAAGCAGATGAACAAGATAAACCTAAGTATACTACTAGACTAGAGTT

TGATACGATTGACATGATTAGGTTTATTAATGACCGAGGTATAAAAGTAC

TATGGGAAGAAGCATATTTCTGTCCTTGTCTTAATCCTGATACAGGACAT

CCTAGAGTAGATTGCCCTAGATGTCATGGTAAAGGTATTGCATATCTACC

TCCTAAAGAGACGATAATGGCAATACAGTCTCAAGAGAAAGGAACTAACC

AGTTAGATATAGGTATATTAGATACAGGTACTGCAATAGGTACCACTCAA

TTAGAAAAGAGAATTTCCTATAGAGACAGGTTTACTGTTCCTGAGGTATT

GATGCCCCAACAAATGATTTATTTTGTGAATAAAGATAGAATTAAAAAAG

GTATACCTTTATACTACGATGTAAAAGAAATAACTTATATAGCCACTCAA

GACGGTACAGTCTATGAAGAAGATTATGAAATCAAGAATAATAGATTGTA

TTTAAATGAAAAATATGAGAATCATACAGTAACTTTAAAGATACTTATGA

CTTTAAGATATGTAGTATCAGATATACTAAAAGAAAGTCGTTATCAATAT

ACTAAGTTTAATCAACCTAAATCAAAATTTGAAAACTTACCTCAAAAATT

ACTTCTTAAAAGGGAAGATGTCATTGTACTACAAGACCCTTATAAAGTTA

ATGATGGTATAGAAGAAGACCTAGAAATTCAAGTAGATGACCCTAAGGCT

TCGGCATCTAATCCTAGTAATTTAGGTGGATTCTTCGGAGGTGCATTTAA

ATAATGCCAGTTCATGGAAAGAGACCTAATTTATTTAAAAATAAAAACTA

TAAGCAGGTAGGTAAGAGAACAATTGATGGTATGCGTTCAGAAGTTCTTG

ATAAATTACAAGCAACAGCACAGCAAGTAGAGAATACTAGTATTAAACGT

ATCCCTACTTATCTACAAATAACAGAGAAAAAGCTTGAAAAAGAAGGAGT

AGTAGACCTTAAAAAAGCTTTTGCTCACTCATCTAAAAAGAAAACTAGTA

AAGATGGCGGATGGTATTTAACTGTACCAATCCGCATCAAAACTAGTAGA

ATGAATAACAGTACTTATCAAGATATGAGAACTTTAAAAGTAGATAAAGG

AACAGGTTCAGTTTCGAAGATAACTGATTACCTAGAAGGACGTAGGAAGA

ATGTAAGCCACCCTTCAATGAAGCCTGAACCTATGACTCATAATATGACT

AAAGTTAAAAGAGGAAAGCAATCTTCTTACTTTATATTTAGAACTGTTTC

TAGTAAGTCACCTGCTAGTTCTTGGATACTTAACAGAGATAAAGTTAATG

AAGATAACTTCTCTAAAACAACTCTAAAAACTGTTAAGCAATTAATGAAC

TGGAAGATGAAAAATTTAAATTAAGAGGAGGGTTAGTATTAAATGGCAAT

AACATCAGTTGATTCATATTTATTATCAGAAATAAAGCCTAGACTTAACA

CTGTGCTAGAGAATTGTTATATTATAGATGAAGTTTTAAAAGACTTTGAT

TATCAAACTAGAGAGAGCTTTAAAGAAGCTTTCTGTGGTAAGAATGCACA

ACATGAAGTAACGGTAGGATTTAACTTCCCAAAATTTAAAAATAACTATG

AAGCTCATTACTTGATACAATTAGGTCAAGGACAAGAGACAAAAAACTCT

TTAGGGAGTATTCAGTCATCTTACTTTGAGGCAACAGGAGATACTTTAGT

CGAATCTTCTACAGCAATAAGAGAAGATGATAAGTTAGTTTTTACTGTTT

CTAAACCAATAGGAGAGTTAATAAAGGTAGAAGATATAGAGTTTGCTAAA

TACGATAATCTTCAGGTTGAAGGTAATAAGGTATCATTTAAGTATCAAAC

AAATGAAGATTATGAGAACTACAATGCTAACATTATATTTACCGAAAAGA

AAAATGATTCTAAAGGTTTAGTAAAAGGATTCACAGTTGAAGAACAAGTA

ACAGTTGTAGGTCTTTCATTTAATGTAGACGTTGCAAGATGTTTGGATGC

TGTACTGAAAATGATTTTAATATCTATGAGAGATAGTATAGAAGAGCAAC

AAACATTCCAATTACAGAATTTGTCTTTTGGTGATATTGCACCAATAATA

GAAGATGGTGACTCAATGATTTTTGGTAGACCAACAATTATTAAGTACAC

AAGTTCTCTAGATTTGGATTATACTATTACACAAGATATTAATAAACTAA

CTTTTAAAGAAAGAAAGGATTGGAAGTAGGATGGCTAGAAAAAAGACACC

TGAAAATAACACTCCTAAATTTAATGGTTATGTTCATATAGATACATTCC

TTGATACTGCAAAAACCCTTTTTAATATGAGGGATTCACAAGTAGCAGGA

TTTAAAGCTTATATGGAAGGTAGTCATTATTTGTTTAGTGAGCAAGAATT

CTTACCATCATTAGAGAAGTATCTAGGTAGGAAATTAGATATATAATAAC

ATTCAGATAAGGAGAATTAAATATGGCAGTAGAACCATTCCCAAGAAGAC

CTATTACCCGTCCTCATGCATCTATTGAAGTAGATACTTCAGGTATCGGT

GGCTCAGCAGGTTCAAGTGAAAAAGTATTTTGCTTAATCGGTCAGGCTGA

AGGCGGAGAACCAAATACAGTTTATGAATTACGTAACTATTCACAAGCTA

AACGTTTATTCCGTTCAGGAGAATTACTTGATGCAATAGAATTAGCATGG

GGTTCTAACCCTAACTATACAGCAGGACGTATTTTAGCTATGCGTATAGA

AGATGCTAAACCTGCTTCAGCGGAAATTGGCGGATTAAAAATAACATCTA

AAATCTACGGTAATGTTGCTAACAACATTCAAGTAGGATTAGAAAAGAAT
```

```
ACACTAAGTGATTCATTACGTTTAAGAGTAATATTCCAAGATGACCGTTT
CAATGAGGTTTATGATAATATCGGTAATATCTTCACAATCAAGTACAAAG
GAGAAGAAGCTAACGCAACTTTCTCTGTAGAACATGATGAAGAAACTCAA
AAAGCAAGTCGTTTAGTATTAAAAGTTGGAGACCAAGAAGTTAAGTCATA
TGATTTAACTGGTGGAGCTTATGACTACACTAATGCTATTATTACAGACA
TTAATCAATTACCTGATTTCGAAGCTAAATTATCACCTTTCGGAGATAAG
AACTTAGAATCTAGCAAATTAGATAAAATTGAAAATGCAAATATAAAGA
TAAAGCTGTATATGTAAAGCAGTTTTTGGTGACTTAGAAAAACAAACAG
CTTACAATGGTATCGTATCTTTCGAGCAACTTAATGCAGAAGGAGAAGTA
CCAAGTAATGTAGAGGTTGAAGCAGGAGAAGAATCAGCTACAGTAACTGC
TACTTCACCTATTAAAACTATTGAACCGTTTGAGTTAACTAAGTTAAAAG
GCGGTACTAATGGTGAACCACCTGCTACATGGGCAGACAAGTTAGATAAA
TTTGCACATGAAGGCGGATACTACATTGTTCCATTATCATCTAAACAATC
AGTTCATGCAGAGGTAGCTTCTTTTGTTAAAGAACGTTCTGATGCAGGAG
AACCAATGAGAGCTATTGTTGGTGGAGGATTCAATGAATCTAAAGAACAA
TTGTTCGGTAGACAAGCATCATTATCTAATCCACGAGTATCATTAGTAGC
TAACTCAGGTACTTTTGTTATGGATGATGGACGTAAAAACCACGTACCTG
CTTACATGGTAGCCGTAGCTCTAGGTGGTCTTGCAAGTGGTTTAGAAATC
GGTGAATCAATCACATTCAAACCACTACGTGTAAGTTCATTAGACCAAAT
CTATGAGTCAATAGACTTAGATGAATTAAATGAAAATGGTATTATTAGTA
TAGAGTTTGTTCGTAACCGTACTAATACATTCTTCAGAATCGTTGACGAT
GTAACTACATTCAACGATAAATCAGACCCAGTTAAGGCTGAAATGGCTGT
TGGGGAAGCTAATGACTTCTTAGTAAGTGAGCTTAAAGTTCAACTTGAAG
ACCAGTTTATTGGTACTCGTACTATTAATACAAGTGCTTCAATCATTAAA
GACTTTATCCAATCTTACTTGGGTCGTAAGAAACGTGATAATGAAATTCA
AGACTTCCCTGCTGAAGACGTACAAGTTATTGTTGAAGGTAACGAAGCAA
GAATTTCAATGACAGTTTACCCAATCAGAAGCTTCAAGAAAATCTCTGTT
AGCTTGGTTTACAAGCAACAGACATTACAAGCCTAGTCTAGGTGACGGAG
TACCTGGATTAGGTACTCCTATTAATATAATTTGAATACTTTAGGAGAGT
GAATACAGATGGCATCAGAAGCTAAACAAACCGTCCATACTGGTAATACC
GTCCTACTTATGATTAAAGGTAAACCGGTAGGAAGAGCACAATCAGCATC
AGGTCAACGTGAATACGGTACAACTGGTGTATACGAAATCGGTTCTATCA
TGCCTCAAGAACACGTATACTTACGTTATGAAGGTACAATTACAGTAGAA
CGTTTACGTATGAAAAAGAAAACTTTGCAGATTTAGGATATGCTTCACT
TGGTGAAGAAATTCTTAAGAAAGACATCATTGATATTTTAGTAGTAGATA
ACTTAACGAAACAAGTTATTATCTCATATCATGGTTGCTCTGCAAATAAC
TACAATGAAACTTGGCAGACAAATGAAATTGTAACAGAAGAAATCGAGTT
TAGTTACTTAACAGCAAGTGACAAAGCACGTACTTAATAGATTAGACCAA
CTAAAAAGTTGGTCTTTTTTTATTGACACTTTAAAATTTATATGTTATTA
TAAATATAATAATTTAAACAGGAGATGTACTAGATGGCAAATAAGAGAAA
AACAATAGGAAAAATGAGTAACACAAGAGCAACATGGAATATTAATCCGG
```

```
TAACTAAAGTTAAAAAAGATAAAACAAAATATTCTAGAAAAAATAAACAT
AAAGGTCTTGACAATTATAATTAACTAAGGTATATTATTAGTATAACAAA
AAAAGGAGATGGGTATATGAGTACATTTTGGTCAGAAAGAAGAACAACTA
ATAAAGATAGGCAAGTTAAAAAACATTATACTCAAATGAGTATGTATGAA
AGAAAGAAATGTGTAGAGTTATTACAAGAGACAATTACTGAAAATAGAAT
TATTAATTTTACACGACATAGTGCAAAAAAGGTTAAAGGTAAACCAACAA
CAAATATACCTAAATTAATAGGTTTTATTTTTAAAAATAAGTTTGCCTAC
GAAAATATCATAGAGTACAATAACACAGATTATAATGGTAATATTGAGAG
GAGAATTGTTGTTAAACATCCTAAAGTTATAACTGTAGAAGGAAAACCTA
GCTATCAGTTTTTGACAATTAGTCTTGAAGATGCTAGAGTTATTACGGTG
TGGTATAACAGTGTAGATGATACACATAGAACACTAGATTTAAATTATTA
TAGTAAAGACTTGACAATTCAATAAGGAGGTATTATAATGGGTATAACAA
TAGTAAATAGTTATTTTATTCTGTCTAGCATTTTCCTCATCATATTAACC
ATATTAAATGGTAAGGGTACAGTTACAAGGGAATCATTAACTATGAGTAA
AATATTAGTAGTAATAACATCAATTCAATTTTTAGCATGTTTAATTATTA
ATGGTATTTATTGGTCACTAAAATTTATGTAGTAGAACTAGAATAAAAGT
ATTGACAAATTAAAACTAATAAATTATAATAAAGGTATAACAAATTAAAG
GAGAAGATATAAAATGTCACAAGATAAATTAAGAGCAATTTACACAGAAA
TGAAAGTAGAATTACACAAATTTCCTAAAGAGGTAGATATAACAAGTAAA
TCAACTGCAATTGCAATCAATCAGATTTTAGATAAATTCAAAACATTAAC
AGAACAAGCAGGAAAGATTACTAGAAAATATTTAGAAGGTCAAGAAATAT
TAACTATTGATTATGAGTATTATGATTCATTACAAGAATACTATATTTAC
CTACTTAGAAATAGTGAAAAGATTGAACAAAGTTTACAAGAAATTACTAA
GCGTACAGGTAATATGTAAAGTAATTTTGATTTAAAAACAAAATATGAT
ATACTATGTTTAAAGTAGTAAGCCTACACTAGTCCGTGTTATATTAATAT
TGAATCGGATAAGCGTAGGCTTTATTAATATTTAAAAAAGGAAGGTATAT
CATATTATGGCAGAAGAAATTAAAAAGGAACAAGATGTACAAGAAACAAC
TAAAGAAGAAAAAAAGATGTTAGTAAAATGACACCGGAAGAAATAGATA
AATTAAAATATCAAGACAAACAAGAAAAAGAACAAGTTATTAACAAAGTT
ATTAAAGGCGTTAATGATACTTGGGAAAAAGAATATAACTTTGAAGAACT
AGACTTAAGATTTAAAGTTAAGATTAAATTACCTAATGCACGAGAACAAG
GTAATATCTTTGCGTTACGTTCTGCTTACTTAGGTGGTATGGATATGTAC
CAAACAGACCAAGTGATTAGAGCATATCAAATGTTAGCTACCTTACAGGA
AGTAGGTATTGAAGTTCCTAAGGAATTCCAAGACCCTGACGATATTTATA
ACTTATATCCTTTAACTGTTATGTATGAAGATTGGTTAGGATTCTTAAAC
TCCTTTCGTTACTAATAGTATAGAAACATTAGATAAAGATATAGAACGAT
TGGGCGGTATGGAATCAATTGTTAAACAACCTTTATCTAGAAATCTATGG
GCTATTATGAAAGAGTTTAATGTTTTACCTACCGAGCAAAGATTTAAGGA
CTTAGACGATTATCAGATAGAGTTTATTATTGGGAATATGAATAGAGATG
TTTATGAACATAATAAACAACTTAAACAAGCTCAAAAAGGTGGAAAATTC
```

-continued

```
GATAGTCAATTCGAAGATGATGATAGTAGTTGGTGGAATGAATCTCATGA
AGACTTTGACCCAGTACCTGATTTCTTAGATGCTGATGATTTAGCACAAC
AGATGGAAGCTAAATTATCCGATAGAGATAAGGAAGAAAGAGCTAAGAGA
AACGATGCAGAGTTAAATGATGAAACAGAAGGACTTACTACACAACATCT
AGCTATGATGGAATACATCAGACAGAAACAACAAGAATTAGATGATGAAG
TAGGAAATGGTAAGACTAGTGAAGATGACGCTACTATATCACAAGATAGC
GTTAATAAAGCACTAGAAGACCTAGATGATGACTGGTATATGTAAAGGGT
GGTAGGTGATACTACCATCCTTATTTTTTTAAAATGGATGGTGAATAATG
ATGGCAATGAATGACGATTATAGATTGGTCTTGTCCGGTGATAGTTCGGA
TTTAGAATAGTCTAAAGGCAATAGAACTTTATATGGATTCTTTAGAGT
CTAAGAATATTGATGCTCCTTTAGATAATTTCTTAAAAAAATTAAAAGTA
ATTGCTAAAGAAGTTAAAAATGTACAGAACGCAATGGATAAACAAGATGG
TAAATCTGTTATATCTTCTAAAGACATGGATGAATCTATTAAATCCACTC
AATCTGCTACAAAGAATATAAATGAATTAAAGAAAGCTTTAGATGACCTT
CAAAAAGAGAATATATCTAAAGGTATTGCACCTGACCCTGAAGTTGAAAA
AGCATATGCTAAGATGGGTAAAGTTGTAGATGAAACTCAAGAAAAACTTG
AGAAAATGTCTTCACAAAAAATAGGTTCTGATGCTAGTATTCAAAATAGA
ATTAAGGAAATGAAAACCTTAAATCAAGTAACTGAAGAATACAATAAAAT
AAGTAAAGATTCTAGCGCAACTAAAGATTATACAAAACGATTAAGAGCTA
ATCGTAATATGACTAGAGGTTACATGGAGCGTTCAGAAGGAACAGGACGT
TTGACATATGACCAAGGTGCACGAGTTAGAAGTGAACTAGGTAAAGTAAG
TTCTTATGAGAGCCAAAGAAAACAAAACCAACGTAATTTGGAACAAGCAA
GAGAACAATATAGCAACTATAGAAACCAACAACAAGACTTGACTAAACGT
AGAGCTAGCGGTCAAATTAATAAGGCACAATATGAACAAGAGTTAGCTTC
TATTAAACAGGAAATGAAAGCTAGAGAAGAACTTATATCTAACTATGAGA
AATTAGGAGCAGAACTTGATAAAACAGTTCAGTATTATAAGGGTTCAGTT
CAAAAGGATTTCCAATCTAGAGACGTAGACCAACAAAGAGGAACATTTGG
TAGAATGGTTCAAGAACGTTTGCCATCTATTGGTTCTCATGCTATGATGG
GTACTACAGCTATGGCTACAGGTTTATACATGAAGGGTGCCTCACTAAGT
GAAACTAATAGACCTATGGTTACATCATTAGGTCAAAATTCCGATAATAT
GGATATAGATTCTGTAAGAAATGCATATGGAGACTTGTCAATTGATAACA
AATTAGGTTATAATAGTACTGACATGTTGAAAATGGCTACTTCATATGAA
GCATCAGTAGGACATAAAAGTGATGAGGACACAATGGCAGGAACTAAACA
GCTTGCTATTGGAGGACGTTCTTTAGGCATTAAAGACCAAGAAGCTTATC
AAGAGTCTATGGGTCAAATCATGCATACCGGTGGAGTAAATTCTGATAAC
ATGAAGGAAATGCAAGATGCATTCTTAGGTGGTATTAAACAATCAGGCAT
GGTTGGTCGTCAAGATGAACAACTTAAAGCACTAGGTTCTATAGCGGAAC
AATCAGGAGAAGGAAGAACTCTAACTAAAGACCAAATGAGTAACCTTACT
GCCATGCAATCTACTTTTGCAGAGTCAGGAAGTAAAGGATTACAAGGTGA
ACAAGGTGCCAATGCTATTAACAGTATAGACCAAGGACTTAAAAATGGTA
TGAATAGTTCTTATGCTCGTATAGCAATGGGATGGGGAACGCAATACCAA
```

-continued

```
GGTCTTGAAGGTGGATATGATTTACAAAAACGTATGGATGAAGGTATATC
TAATCCTGAAAACTTGACAGATATGGCTGATATAGCTACTCAAATGGGTG
GCAGTGAAAAGAACAAAAATACCTATTTAATAGAAGTATGAAAGAAATA
GGCGCTAACCTAACTATGGAGCAATCTGATGAAATATTTAAGGACTCTAA
AGAAGGAAAACTGTCTAAAGAAGAGTTAGCTAAGAAAGCTAAGAAAATGG
AAAAAGAAGGTAAAAAGAAGGAGAAGATAACGCCACTGATTATAAAGAA
TCTAAATCAGGAAAAAATGACCAAAATAAATCTAAGACTGATGATAAAGC
AGAAGATACTTATGATATGGCTCAACCACTAAGAGATGCTCATAGTGCTT
TAGCAGGTCTTCCTGCCCCTATATATTTAGCTATTGGTGCTATAGGAGCA
TTTACAGCTTCACTAATTGCATCTGCAAGTCAATTTGGAGCAGGTCACTT
AATTGGTAAAGGAGCCAAAGGACTTAGAAATAAATTTGGTAGAAATAAAG
GCGGTAGCTCCGGTGGTAACCCTATGGCAGGTGGAATGCCTAGTGGTGGT
GGTTCACCTAAGGGTGGAGGCTCACCTAAAGGTGGGGGCACTCGTTCTAC
TGGAGGAAAAATACTTGATAGCGCTAAAGGTCTTGGAGGATTCCTAGTAG
GTGGCGCAGGATGGAAAGGTATGTTTGGCGGGGAGTCTAAAGGTAAAGGC
TTTAAACAAACATCTAAAGAAGCCTGGTCAGGTACTAGAAAAGTATTTAA
TAGAGATAATGGTAGAAAAGCCATGGATAAATCTAAAGATATAGCTAAAG
GTACCGGTAGTGGTCTTAAAGATATCTATAATGATAGTATATTTGGTAAA
GAAAGAAGACAAAACCTAGGAGAAAAAGCTAAAGGTTTTGGTGGCAAAGC
TAAGGGTCTCTATGGTAAGTTTGCTGATAAGTTTGGTGACGGAGGTAAAA
ATGGTATTCTTTCACAATCACCAAAAGCAGGTGGAAGTGGCATAGGGAAA
CTTGGAAAACTTGCAGGTGGACTTGGAAAAGGAGCCGGAGTTTTAGGTGT
TGCTACGTCTGCCTTATCATTAATACCTGCTTTAGCTTCCGGAGATAGTA
AAGCTATCGGCGGAGGAATAGGCTCTATGGGTGGAGGAATGGCAGGTGCA
TCAGCAGGAGCTTCTATAGGAGCTTTATTTGGTGGTGTAGGTGCAATACC
TGGAGCTTTAATAGGTGGAGCTATAGGTTCCTTCGGAGGAGGAGCTGTTG
GTGAAAAAGTCGGAGACATGGCTAAAAAAGCTAACACTAAAGAAGGATGG
AACCTAGGATGGACTAACGGAGATAAGGATGGTAAGAATAAATTCCAAGA
TTCTTTATTAGGAAAACCTATATCTAAAGCATGGAGCGGTATAACAGGTC
TCTTTGATAATGACGCTGAAGCATCCGAAGAAGATAGTAAAGATAAGAAA
AAAGGTGTTAAAGGCGTTAAAGGAGATACTAAGAAGAAAGAAAAATGAC
AGCAGAACAACTTAGAGAAAGAATAACCAATCTGAAACTAAGAATCTTA
AAATCTATAGTGATTTACTTGACAGAGCTCAGAAAATTATTGAGAGTGCT
AAAGGTATTAATATAGATGGAGGAACTTCTGATAGTGGTTCTGATAGTGG
AGGCTCTGCATCTGATGTAGGTGGAGAAGGCGCAGAGAAGATGTACAAGT
TCCTTAAAGGAAAAGGACTATCTGATAATCAGGTAGGAGCTGTTATGGGG
AACTTACAACAAGAATCTAATCTTGACCCTAATGCTAAGAATGCTTCTAG
TGGGAGCATTTGGTATTGCTCAGTGGTTAGGGGCTAGAAAAACAGGATTAG
AAAATTTTGCTAAATCTAAAGGTAAAAAATCTAGTGACATGGATGTTCAA
TTAGATTACCTATGGAAAGAAATGCAGTCTGATTATGAAAGCAATAATCT
```

-continued
```
TAAAAATGCAGGTTGGAGCAAAGGTGGAAGCTTAGAGCAGAATACAAAAG
CATTTGCTACTGGATTTGAACGTATGGGAGCAAACGAGGCTATGATGGGT
ACTCGTGTTAACAATGCTAAGGAATTCAAGAAGAAATACGGAGGCTCCGG
TGGCGGAGGTGGTGGAGGAGCCCTATCCTCTACTTACCAAGAAGCTATGA
GTAATCCTGTATTAACTACTGGTTCTAATTATAGGGGCTCTAATGATGCT
TCTAATGCTTCTACAACTAACAGAATAACCGTCAATGTTAATGTTCAAGG
TGGAAATAATCCTGAAGAAACTGGAGACATTATCGGAGGAAGAATTAGAG
AAGTTCTAGATAGTAACATGGATATCTTTGCAAATGAACATAAGAGAAGT
TATTAGTAATTTTGTATTGACACAAGAGTAGTATCATAGTATACTACTCT
TATACATATAAAAAATAAAAGGAAGTATGTGTATATGCGTAGAATAAGAA
GACCTAAGGTAAGAATAGAAATAGTTACAGATGATAATACATTTACATTG
AGATTTGAAGATACACGAGACTATAATGGTGATGAGTTTGGAGCTAAACT
TTTAGGATTCCAAACTAAAAACTCTATGGAAGATGATAGTTCAGTTTTCC
AAATAAATATGGCAGGAGATACTTATTGGGATAAGCTAGTTATGGCTAAT
GATATCATAAGAATATTTATTACACCTAATGATGACCCTAACGATAAAGA
AGGAAAACAAGAACGACTTATCCAGGTAGGTATGGTTTCTCAAGTATCAA
AAGTAGGTAGTTACGGTAATGACCAAACTCAATTTAGAATAACAGGTCAA
TCTTTTGTAAAACCTTTTATGAAATTTGGATTAGGCGTTATTCAGGAAGT
TCAAGCTGTATTACCTGAAGTAGGTTGGCTTATTGATGGTGATGAGATA
ATGAAGTAAAATTTACTGGTAGCTCAGCTCATGAAGTAATGACTGGTATT
ATACGTAGATTTATACCTTATATGAAATATAACTATACTGAAAAAACATA
TAATACAATTGATAACTATCTTGATTATGATGATTTAAGTAGTTGGGATG
AGTTTGAAAAACTTACAGAAGTTTCAGCCTTTACTAATTTTGATGGGTCA
TTAAAACAGTTAATGGATATGGTAACAGCTAGACCTTTTAATGAGTTATT
CTTCAAAAATTCAGAAAAAACACCTGGAAAGGCTCAACTTGTATTAAGAA
AGACCCCTTTTAATCCTACTGAGTGGAGAGCTTTAGATATGATTAAAGTA
CCTACTGAGGATTTTATAGAAGAGGATGTAGGTAAAAGTGATGTAGAGAC
ATATTCTATATTTACAGCAACACCTGCAGGTATGTTGAAAGAGCTTAACG
GTGATGTATTTTCTAAACCACAATTCCACCCTGAATTAACTGATAGATAT
GGTTATACTAAATTTGAAGTAGAAAATATTTATCTTAGTACAAAATCAGG
TTCAGCTACTGAGGATTCAGATTCTTCAGGTGATGATAATGGCACAGAAC
GAGGAACTTATTCTAAAATTATGAAAGATTTAAGTAACTATGGAAGAGAT
AATATATCTAAAGGTATAGATAAGTATACAAGTAAATTATCTTCAAAATA
TAAAAACTTAAAAAAAGCCCAAGCTAAAAAAATTATAGAGAAGTTTGTTA
AAGAAGGAAAAGTAACAGAAAAAGAATATGAAAAAATAACAGGTAATAAG
GTAGATGATGAATTAACATCAGATAACAGACCGAAGTTGACAAAAGATAA
ATTAAAGAGTATACTAAAAGAGAAGTTTAAAACACAAGATGATTTTAATA
ATTCTAAGAAAAAGAAAAAAGCTAAGACAGATGCACTTAAAGAATTGACA
ACTAAATATCGTTTTGGTAATAAAACACATGCTACAACTTTATTAGATGA
ATATATTAAATATAAAGGAGAGCCACCTAACGATGAGGCTTTTGATAAAT
ATCTTAAAGCTATTGAAGGTGTTAGTAATGTAGCTACAGACACAGGTTCA
```

-continued
```
GATGCAAGTGATAGCCCTTTAGTTATGTTTTCTAGAATGCTATTTAATTG
GTATCATGGTAACCCTAACTTCTATGCAGGAGATATTATTGTTTTAGGAG
ACCCTAAGTATGACCTAGGTAAAAGATTATTTATTGAAGATAAGCAACGA
GGAGACACTTGGGAGTTCTATATTGAATCTGTAGAACATAAATTCGATTA
TAAACAGGGGTATTATACAACTGTAGGAGTAACTAGAGGGTTTAAAAGACG
CTATTCTAGAAGATGGTAAAGGTAGTCCGCATAGATTTGCAGGATTATGG
AATCAATCATCAGACTTCATGGGAGGTCTTATGGGTGAAGATACTTCTAA
AGAACTTAAAGAAAAAGGTGTAGCAGAGAAACAAAGTAGTGGAGATAAAG
ATGGTGGTTCTGATAGTGGTGGAGCTCAAGATGGTGGCTCTTTAGATTCA
CTTAAAAAATATAACGGCAAACTTCCTAAGCATGACCCAAGTTTTGTTCA
ACCTGGTAACCGACATTATAAGTATCAGTGTACATGGTATGCTTATAATA
GAAGAGGTCAATTAGGCATACCTGTGCCTTTATGGGGGGACGCCGCCGAC
TGGATAGGTGGTGCTAAAGGAGCAGGTTATGGTGTAGGTAGAACACCTAA
ACAAGGTGCTTGTGTTATATGGCAAAGAGGAGTTCAAGGAGGTAGCCCAC
AATATGGTCACGTAGCGTTTGTAGAGAAAGTATTAGATGGAGGTAAAAAA
ATATTTATCTCTGAACATAACTATGCTACCCCTAATGGATATGGTACTAG
AACGATAGATATGAGTTCAGCCATAGGTAAGAATGCACAATTCATTTACG
ATAAGAAATAAAGGAGGATAGTCTATGGCAACAGATAAAGAAGCTAAAGA
TGTTATTGATAAATTTATAGACAATGTATTTAATTTTGATGTACTTACAA
AAGAAAGAATAAAAGAAAAAGATGAAGAAATTAAAAAAAATAACTACAGAT
GATATGTATGAAAAGGTTGTGTATATACGACCTTATGTTGGAGTAATACA
AAGCCTTAACCCTCAGCATGTTCAGTATGAATCATTTTCTAATAATGGTT
ATGATATAGAGGCAGAATTAAGTTTCAGGAAAGTAAGTTATTTAGTTGAT
AAAGGGTCTATACCTACAGATTCTTTATCTACTTTAACAGTTCATTTAGT
AGAACGAAATCAAGAACTATTAATAGATTACTTTGATGAGATACAAGATG
TGTTGTATGGAGAATATATGGAAGAAGAATATGTATTTGATGAAGATGTA
CCATTAAGTACGATACTAGCATTAGACTTAAATGATAATCTTAAATCCTT
ATCAAATATAAAGTATATGTTCAAAGGTGCTCCTAAAGAGAATCCATTTG
GAACAGATAAAGATGTTTATATAGATACTTATAACTTATTATACTGGTTA
TATTTAGGTGAAGATGAAGAGTTAGCATATCCTATGAATATTAACTACTT
CTTTACAGAGGGAAGATTCTTTACTATATTCGGTAAAGGACATAAGTATA
AGGTAGATGTTAGTAAATTTATAGTTGGAGATATATTATTCTTTGGTAGA
AGTGATACTAATATAGGTATTTATGTAGGAGATGGGAGTTTATATCTAT
GATGGGTAAATTCCCTAAAGATGAAACACCTATAGGAAAATATAAACTTG
ATGATTACTGGAATGAATTTAACGGAAGAGTTATGAGATTCGATGAAGAG
GTGTATATTTAATGGTAGTAAGATTCCAATCTTCCATGGGGAGAAGTTTA
AAAAGAGTAGATTCGGATGATTTAAATGTAAAAGGATTAGTTTTAGCTAC
AGTTAGTAAAATTAATTATAAATATCAATCAGTAGAAGTTAAAGTTAACA
ATTTAACTCTAGGAAGCCGTATAGGTGATGATGGTAGCTTAGCTGTACCT
TATCCTAAATCTTTCATAGGAAGAACACCTGAAGGAAGCGTATTCGGTAC
```

-continued

```
AAAACCTCTTATTACTGAAGGTTCTGTAGTATTAATAGGGTTTCTAAATG
ATGATATAAATAGTCCTATTATTTTAAGTGTTTATGGTGATAATGAACAA
AATAAAATGATTAATACCAATCCTCTAGATGGAGGTAAGTTTGATACAGA
AAGTGTTTATAAATATAGTAGTTCACTATATGAAATTTTACCATCTTTAA
ATTATAAATATGATGATGGAGAAGGAACAAGTATTAGGACTTATAATGGT
AAATCATTTTCTCTATGACATCAGGTGAAGAAGAGAAACCTCAGGCAAC
AGATTTTTATACTGGAACTGAGTATCAAGATTTATTTACTTCTTATTATG
GTAATAAGACATTAATTGAGCCTAGAATACAAAAGGCTCCTAATATGTTA
TTTAAACATCAAGGAGTTTTTTATGATGATGGCACGCCGGATAATCATAT
AACTACTTTATTTATATCTGAAAGAGGGGATATAAGAGCCTCAGTTTTAA
ATACAGAAACACAGAAAAGAACTACACAGGAAATGTCAAGTGATGGGTCT
TATAGAGTTATCAAACAAGATGACGATTTAATGTTGGATGAAGCTCAAGT
TTGGATTGAGTATGGTATTAGTGAAGATAATAAATTTTATATTAAAAATG
ACAAGCATAAATTTGAATTTACTGATGAGGGAATCTATATAGATGATAAA
CCTATGTTAGAAAACTTAGATGAGAGTATAGCAGAGGCTATGAAGAATTT
GAATGAAATACAAAAGAACTCGATGATATAAACTACCTTCTCAAGGGTG
TAGGTAAAGACAATTTAGAAGAATTAATAGAGTCTACAAAAGAGTCTATA
GAAGCTTCTAAAAAAGCAACTTCAGATGTCAATAGACTTACAACTCAGAT
AGCAGAAGTGAGTGGTAGAACTGAAGGTATTATAACACAGTTCCAAAAAT
TTAGAGATGAGACTTTTAAAGATTTTTATGAAGATGCTTCTACTGTTATT
AATGAAGTAAATCAGAATTTCCCTACTATGAAAACAGATGTTAAGACCTT
AAAGACTAAAGTTGATAACCTAGAGAAAACTGAAATACCAAATATTAAAA
CTAGATTAACAGAACTAGAGAACAATAATAACAATGCTGATAAAATAATC
TCAGATAGAGGAGAACATATAGGTGCTATGATACAGTTAGAGGAAAATGT
CACAGTACCTATGAGAAATATATGCCAATACCATGGAGCAAAGTTACTT
ATAATAATGCAGAGTTTTGGGATTCTAATAATCCTACTCGATTAGTAGTA
CCTAAAGGAATAACAAAAGTAAGAGTTGCAGGTAATGTTTTGTGGGACTC
TAACGCCACAGGACAACGTATGTTGAGAATATTGAAAAATGGTACTTATA
GTATAGGATTACCTTATACAAGAGATGTAGCTATATCTACAGCACCTCAG
AATGGTACTAGTGGAGTTATTCCTGTTAAAGAAGGAGATTACTTTGAGTT
TGAAGCTTTCCAAGACTCAGAAGGTGACAGACAATTCAGAGCAGACCCTT
ATACATGGTTTAGTATTGAAGCTATAGAATTAGAAACTGAAACTATGGAG
AAAGACTTTATGCTTATAGGACATAGAGGAGCAACCGGATACACAGATGA
GCACACGATAAAAGGATATCAAATGGCTTTAGATAAAGGTGCAGATTATA
TAGAATTGGATTTACAATTAACAAAAGATAATAAGTTATTGTGTATGCAT
GATTCTACTATAGACAGAACAACAACAGGAACAGGTAAGGTAGGAGATAT
GACCTTATCTTATATACAAACTAACTTTACATCTCTCAATGGTGAGCCGA
TACCATCTCTTGATGATGTACTAAATCATTTTGGAACAAAAGTTAAATAT
TATATAGAAACTAAACGTCCGTTTGATGCTAATATGGATAGAGAATTATT
AACTCAATTAAAAGCAAAAGGATTAATAGGAATAGGTTCAGAGAGATTCC
AAGTAATTATTCAATCATTTGCTAGAGAATCTTTAATTAATATTCATAAT
```

```
CAATTCTCTAATATACCTTTAGCTTACCTAACAAGTACATTTTCTGAAAG
TGAAATGGATGATTGTTTAAGTTATGGTTTTTATGCTATTGCGCCTAAAT
ATACAACTATAACTAAAGAATTAGTAGATTTAGCTCATAGTAAAGGGCTT
AAAGTCCATGCATGGACGGTAAACACAAAAGAAGAAATGCAAAGCTTAAT
ACAAATGGGTGTAGATGGATTCTTTACAAACTACCTAGATGAATATAAAA
AGATTTAATATTAAAGACCTATTAATTTAGGTCTTTTTTTAGTTGTAATT
TAAACTAGTTCGTGATATATTAGTAGTATGAGATTTATATACATACTGAA
AAGGAGAGGATAAAATGCCACAATCAGATGGAATAAGTAATCTTCATAGA
ATAGCTTTACGCTTCCCTAAAGAAGGCGGTGGTTATGATATGTATAGATT
TAAAGTTAACCCTGAGAACTACACAATAGATTCACCACAACGTACGAGAG
CAATTAAAAGAAAATCAGATATTGTAATAGAAGATTATGGTAAAGACATA
GAAGTTATTAACTTCACAGGTACAACTGGTTTTAGACCTGTTAGAGAAGC
AGATGGATTAAAAACAGGTAAGCAGAAAATGGAAGAGTTACAAAGTAGAG
TTAGTGAATATGCTATGCAAGGTGGCAGTGGTAATGTAAGTGGTTCTTAC
TTACAATTTTTTAACTTTACAGATGATAGTTATTATAAAGTTCATTTAGC
TCCTCAGGGGTTAAAGATAACTAGGTCTAAAGATGAACCATTACTTTTTA
GATATGAAATAACATTAGTAGTTATTGGTTCATTAACAGAAGCAGATAGA
AGTGCTGTAACAACAGAAGAGTTTGGTAACGTTAAACCTAATGCTTCTCA
AAGAGTAGATGAGGGTATAAAAGAATTAGATAAAAATGCTCGTAAAACGA
GAGATAGAAAGAATGAAGAAATATCTAGAAGAGAAAATACAATACCTAAA
TCTACAGGAGATAATACGAACGAGGGTAATAGACTTAAGCAAAGCTTCCC
TAGTAGTTCTATATATAATCCTAGACAATCTACTAACGGATTAAAAGGTA
ATATTGACAATATGGCGCTGATAATAGGTTACGGTGATGGAGGTGTATCT
AGCTAATGAATAATTTTATACCACACCTCAAGGTCTACTTAGATTTTTA
AATACCCTAGATACAGATTTAACTTCTTCTCATATGAATTTACTGGATGA
AGAGGTATCATTTGTATCTAAATTTTATACACCACAGCTACAATTAAGTG
AATTAGCAAAAAAAGTATTGACAAATATAAAGACAGATGATATACCTGTA
TTAGAAAGAGAATTTAATGATAATACAATTATCCATAAAGCTAACGATAC
ATTACTAAAAGTACAGGCTCCAAGAATGTATATGATTCTACAGTCGATTG
TACTTGAAGCATATGCTATTGTTAATTGCTTTGTAGAAAATCCGAGCTCT
TTAAAATACTTAACTGAAGAAGATGTTAGTATAACACGGGAAAATTTAAA
TTATGTAGCTGACTACTTAGGTAACTATGATGACTATAATAGTGTTGTCT
TAGACTTAAGAGATTTAGACTTATGTTTTAGTGCTATAGAATTACAATTA
CCTCTAATCAAAAAGGAGGCTAACGTATAATGAGATTTAAGAAGCACGTA
GTTCAACATGAAGAAACGATGCAAGCAATAGCACAGAGATACTATGGTGA
TGTGAGTTATTGGATAGACCTAGTAGAGCATAATAATTTAAAGTACCCCT
ATTTAGTAGAAACTGATGAAGAAAAAATGAAAGACCCTGAACGATTGGCT
TCTACAGGTGATACACTGATTATACCTATAGAATCTGATTTAACAGATGT
ATCAGCAAAAGAAATTAATTCTAGAGATAAAGATGTACTAGTTGAATTAG
CTTTAGGAAGAGATTTAAATATTACTGCAGATGAAAAGTATTTTAATGAA
```

```
CATGGTACTAGTGATAATATACTAGCATTCAGCACAAATGGTAATGGAGA
TTTAGATACTGTAAAAGGCATAGATAATATGAAACAGCAATTACAGGCAC
GTTTATTAACTCCTAGAGGTTCTTTAATGCTACATCCTAATTACGGTTCA
GATTTGCATAATTTATTTGGTCTTAATATACCTGAACAAGCTACATTAAT
AGAAATGGAAGTATTGAGAACATTAACATCAGATAATAGAGTAAAATCTG
CTAATCTAATTGATTGGAAAATTCAAGGTAATGTTTATTCAGGTCAATTT
TCAGTGGAAATAAAATCTGTTGAAGAATCAATAAATTTTGTCTTAGGACA
AGATGAGGAAGGAATTTTTGCTTTATTTGAATAGGAAAGGATTAAATTAT
GAAAACTAGAAAATTAACTAACATACTATCAAAATTAATAGATAAGACAA
TGGCAGGTACAAGCAAGATAACAGACTTTACTCCTGGTTCAGCTTCTCGT
TCATTATTAGAAGCTGTATCATTAGAGATAGAGCAATTCTATATTCTAAC
AAAAGAAAATATTGATTGGGGTATACAAGAAGGTATCATTGAAGCTTTTG
ATTTTCAAAAAGACAATCTAAAAGAGCTTATGGTGATGTTACTATTCAA
TTCTACCAACCCTTAGATATGAGAATGTATATACCCGCAGGAACAACTTT
TACTTCAACACGACAAGAATACCCTCAGCAATTTGAAACATTAGTTGATT
ATTATGCAGAGCCTGATTCTACTGAGATTGTTGTTGAAGTTTATTGTAAA
GAAACAGGGGTTGCAGGTAATGTTCCTGAAGGAACAATTAATACTATAGC
ATCAGGTTCTAGTTTGATTAGAAGTGTTAATAACGAGTATTCTTTTAATA
CAGGAACTAAAGAAGAGAGCCAAGAAGACTTTAAGCGCAGATTCCACTCT
TTTGTAGAATCTAGAGGTAGAGCAACTAATAAATCAGTAAGATATGGTGC
ACTGCAGATACCTGATGTAGAAGGTGTTTATGTTATGAAGAAACAGGAC
ATATTACAGTATTTGCTCATGATAGAAACGGTAATTTATCAGATACCTTA
AAAGAAGATATAATTGATGCTTTACAAGACTATAGACCAAGTGGTATAAT
GTTAGATGTTACAGGTGTAGAAAAAGAAGAAGTTAATGTTTCTGCTACAG
TAACTATATCTAATAAATCTAGAATTGGTGATACATTACAAAACATATC
GAAAGTGTTATTAGAAGCTATTTAAATAATTTAAAAACTTCTGATGACCT
AATAATTACAGACCTTATTCAAGCTATAATGAATATTGATGATGTATTAA
TATATGATGTGTCATTTGATAACCTAGATGAGAACATTATAGTACCGCCA
CAAGGAATTATTAGAGCAGGAGAAATAAAAGTAGAACTAAAGTAAAGAGA
GGTGAAACTTAAGTCGTGGCTAATTTTTTAAAGAATCTTCATCCATTATT
AAGAAGAGATAGAAATAAAAAAGATAATCAAGACCCTAACTTTGCTCTGA
TAGATGCACTCAATGAAGAGATGAATCAAGTAGAGAAAGATGCTATAGAA
AGTAAGTTACAATCTTCTCTAAAGACATCTACCAGTGAATATTTAGATAA
GTTTGGGATTGGTTCGGAGTTTATCGTAAGACCGATGAGAAAGATGATG
TTTATAGAGCAAGAATTATAAAATATTTACTCTTGAAAAGAGGAACTAAT
AATGCTATAATAGATGCTATAAAAGATTATTTAGGTAGAGATGATATTGA
TGTAAGTGTATATGAACCTTTTACAAATATTTTCTATACTAACAAATCAC
ATTTAAATGGTGAAGACCACTTAATGGGATACTATTATAGATTTGCTGTT
ATTAATGTCTCTATAGGTGATTATTTCCCTGTAGAGATTATAGATGTAAT
TAATGAATTCAAACCTGCAGGTGTAACTCTATATGTCACTTATGATGGGG
CTTCTACTATTAGAGGTGGAGCAATTATTAAGTGGTTAGATGGGTTACCT
AAAATAGAAACATACCAAGAGTTTGATAGATTTACAGGTTATGATGATAC
ATTCTATGGTCATATTAATATGAATCAAAGTAAAGATACTGATAACAGTT
CATCAGATATTTTTAAAACAAACCATAGCTTAATTAATAGTTTAGATGTT
TTAACAGGTTCATCTAGTGTAGGGAGACAGTATATTAACTACGGATATGT
AACATCATATGTTTATAATCCAGGTATGACATCTTCTGTAAATCAATAA
GCGCTAGTACAGAAGGTAGAGGTCAAGAAGTACCTACTGACTATTATATG
TATACTAGTACTAAGAATAACAATACAGTAGAACTTAGTATGCAAACTAC
TTCCGGTGTGTCTTATTTATATAATAACTTTAATTTTAGGGACTATATGA
GTAAATATAGACCTCAAGTAGATTTACAATCTGATGAGGCTAGAAGAATT
GTATCTGATTATATAAAGAATTAAGTATTGATTACTATCTTAGTGCTGT
GATACCTCCTGATGAAAGTATAGAAATTAAACTACAAGTTTATGATTTTT
GTATTAATAGATGGCTTACAGTATCAATTAATAATTTATCTTTCTATGAA
AAAAATATCGGGAGCAATATAGGATATATAAAAGATTATCTAAACAGTGA
ATTAAATATGTTTACTAGGTTAGAGATAAATGCAGGTAAAAGAGATTCAG
TAGATATTAAAGTTAATTACTTAGATTTAATGTTTTATTACTATGAACGA
GGTATTTATACAATAAAACCGTATAAAGCATTAATAGAAAATTATTTAGA
TATATCTAGAGAGACTTATGTAGAAGCATTTAAAATAGCATCATTATCTA
ATGGAGATATTATAACTAAAACAGGTTTTCAGCCTATAGGGTATTTAAAA
CTAGTTGGTAATTATGAAAATACAATACCTAGCACAATAAATATAGTAGC
TAAAGATACAGATAATAACCCTATAGAATCTAATGAATTAGATGTATATA
ATACAGTAGAGAATAGAAATTTATTACAATCTTATAAAGGTGTAAATACG
ATAGCTAGAGAAATAACTTCTACAAAAGAGTTTAGTGTATCAGGATGGGC
TAAAGAGATATACTCAACTAATTATCTTTCTAAAGTATTAAAACCAGGTA
AAGTGTATACGTTATCTTTTGATATGGAAATAACAGGTAATGACCCAACT
CTTAAATCTTATTCTGATAATCATGGTATATATTTATACAGTAATACTAA
GGGAATTGTTGTTAATGGTGTTAAATCTATGGAACGTACTATAGGTAACA
AAGTATCCGTAACTCAAACTTTTACAGCCCCTACTATTACTGACCATAGA
TTACTAATATACTGGAAGATATACATCTGATGGTAAAGCATCAACTCC
TCCAGTGTTCTTTAATACAGTTAAAATTACGGAATTAAAATTGACTGAGG
GTTCTTCTAAGCTAGAGTACTCACCTGCTCCGGAAGATAAACCTAACGTA
ATAGAAAAGGAATTAAATTTAATAATATCCTAACTAATATACAGACTTT
AAGTATTAATTCGGATACTATCTTAAAAAATGTAACTTTATATTATTCTT
ACTATGGTGATAGTTGGGTAGAACTAAAGACTCTAGGGAAATATTAGTACT
GGAGAAACAACAGAAACCAATAACTTAATAGATTTATATGGATTACAGAC
AGTAGATTATTCTAATATAAATCCAATGTCTAAAGTATCATTACGTTCCA
TTTGGAATGTTAAGCTAGGTGAATTGAACAATCAAGAAGGTTCTTTATCT
AATATGCCTAATGATTACTTTAATGCTGTATGGCAGGATATAGATAAATT
ATCAGATATTGAGCTAGGTTCTATGAGAATGGTTAAAGACACTGAGGGCG
GAGTATTCGATGGAGCTACAGGTGAAATTATTAAGGCTACTCTATTTAAT
GTCGGTGCTTATACTGATTTAGATATGTTAGCCTATACTTTGACTAATTA
```

-continued

```
TACTGAACCGTTAACGTTAGGCTCTAGTCGATTAATAAGTGAGCTAAAAG
AAGAACTACTAACATCAGAATCATTTAATGTCGATAATAGAATTAAAGTA
ATTGACTCAATATATGAGGAGTTACCAAATACAAGCATTATTAAAAATGG
ATTTGTTGAAAGAGAAGTTACAGGTTCTAAATATTTAGATTACGGTTTAT
ATGAGCCTATAGAAGATGGTACTAGATATAAACTTATTGTCGAAGGAGAA
TTTAAAGATAATATAGAATTTATATCTTTATACAATTCTAACCCTAACTT
TAATGAAACATTTATATATCCATCAGAGATAATTAATGGAGTTGCTGAAA
AAGAATTTATTGCAAAACCATCTACTGAAGACAAACCAAGGTTAAATACA
GATGTTAGAATATATATACGACCTTATGATTCAACTATCTCTAAAGTAAG
AAGAGTAGAATTAAGGAAAGTTTAATAAATAAGTTGACAGAAAGTTAATA
ATATGGTATACTTATAAAGTAATATTTAGTGGGTATACCATGTTATATTA
ATAAAGAAAACAACAGATGAAAGGAATTAAAAAATATGGCAATTGCAACG
TATAATTCTCATGTTGAGTTAGCAAAATATCTAGTTAGTAAAGCTGATTC
AGTTTACTTAACAATTGGAAAGAGCACACCGTGGTCTAATGAAACAAACC
CACCGCAACCTGATGAAAATGCAACAGTATTACAGGAGGTTATTGGATAT
AAAAAAGCTACTAAAGTTACTTTAGTTAGACCTTCTAAATCACCTGAAGA
TGATAATAAGAATTTAATTTCTTATGGTAATAAATCGTGGGTAGAAGTAA
CACCTGAAAATGCTAAAGCTGAAGGAGCTAAATGGGTTTACTTAGAAAGT
AGTATTGTTGGTGACGAACTACCTCTTGGAACATATAGACAAGTAGGATT
TGTTATGGACTTAGTAGCAAAAAGTGGTATTAGTAAATTTAACTTAGTAC
CTAGTGAAGTAGAATCAACTGGAACATTATTATTCTTTGATAATAAACAA
TTCCAAAATAGAAGTGAGCAGACAACTGCTAAAGAAAGATTTATTGTAGA
AGTTTAAAGAAAGGGAGATAATTCTAAATGGCAATTAATTTTAAAGGTTC
ACCTTATTTAGATAGATTTGACCCGTCTAAAGATAGAACAAAAGTATTAT
TTAATCCTGATAGACCTCTACAACAGGCAGAATTAAATGAAATGCAGTCT
ATAGACCAATATTATTTAAAAAATCTAGGAGACGCTATTTTTAAAGACGG
AGATAAACAATCAGGGCTTGGATTCACATTGTCTGAAGATAATGTATTGA
CAGTAAATCCTGGTTATGTATATATCAATGGTAAAATAAGATATTACGAT
AATGACGATTCAGTTAAAATAACTGGCGTAGGTAAAGAAACTATTGGTAT
TAAATTAACAGAACGTATTGTTACACCTGATGAAGATGCTAGCCTATTAG
ACCAAACTAGTGGAGTACCAAGTTACTTCTCTAAAGGTGCAGATAGATTA
GAAGAAAAGATGTCATTAACAGTTAATGACCCGACATCAGCAACTATTTA
TACTTTCATGGATGGGGATTTATATATTCAATCAACTAATGCTGAGATGG
ATAAAATCAACAAAGTATTAGCTGAACGTACTTATGATGAGTCAGGTTCA
TATAAAGTAAATGGTTTTGAACTATTTTCAGAAGGTAATGCTGAAGATGA
TGACCACGTTTCTGTAGTTGTAGATGCAGGTAAAGCCTATGTAAAAGGTT
TTAAAGTAGACAAACCCGTATCAACAAGAATTAGTGTACCTAAATCTTAT
GACTTAGGAACAGCAGAAAATGAAAGTACTATCTTTAATAAGTCTAATAA
CTCTATTAGTTTAGCTAATAGCCCTGTAAAAGAAATTAGACGTGTTACAG
GTCAAGTACTTATTGAAAAGAACGAGTTACAAGAGGAGCTCAAGGTGAT
GGTCAAGATTTTCTTTCAAATAATACAGCATTTGAAATTGTAAAAGTTTG
```

-continued

```
GACTGAAACAAGCCCTGGAGTTACTACAAAAGAGTATAAACAAGGAGAAG
ACTTCAGATTAACAGATGGTCAAACAATTGATTGGTCACCTCAAGGTCAA
GAACCTTCAGGAGGTACTTCATACTACGTTTCTTATAAATATAACAAACG
TATGGAAGCCGGTAAGGATTATGAAGTAACAACTCAAGGTGAAGGGTTAA
GTAAGAAATGGTACATTAACTTTACACCTTCAAATGGTGCTAAACCTATT
GACCAAACAGTAGTATTAGTAGACTATACTTACTACTTGGCTCGTAAAGA
TTCAGTGTTTATTAATAAGTATGGTGATATTGCAATATTACCTGGTGAAC
CTAATATTATGAGATTAGTTACACCACCATTAAACACAGACCCTGAGAAT
TTACAATTAGGTACAGTTACAGTATTACCTGATTCAGATGAAGCCGTATG
TATTTCATTTGCAATCACTAGATTGTCTATGGAAGACTTACAGAAAGTTA
AAACAAGAGTAGATAACTTAGAGTATAACCAAGCAGTAAATGCTCTAGAT
GATGGTGCTATGGAAGGACAGAACCCTCTAACATTACGTTCAGTATTCAG
TGAAGGTTTCATTAGTCTTGACAAAGCAGACATTACACATCCTGACTTCG
GAATTGTATTTAGTTTTGAAGATGCAGAAGCTACTCTAGCTTATACAGAA
GCAGTTAACCAACCTAAGATTATTCCAGGAGATACAACAGCTCATATTTG
GGGTAGATTAATTTCAGCACCATTTACTGAGGAACGTACAATCTACCAAG
GTCAAGCATCAGAAACATTAAATGTTAACCCTTATAATATTCCTAACAAA
CAAGGTGTGTTAAAATTAACACCTAGTGAGGATAACTGGATTGATACTGA
AAATGTTACAATCACTGAACAAAAAACTAAAAAAGTAACTATGAAACGAT
TTTGGAGACATAATGAAAGTTACTATGGTGAGACTGAGCATTACTTGTAT
TCTAACTTACAGTTAGATGCAGGACAAAAGTGGAAAGGTGAAACTTACGC
TTATGATAGAGCATGGTCGTACCGGTACTTTATTGGAATCAGGAGGAC
AACGTACTCTAGAAGAAATGATTGAATTCATTAGAATCAGAGATGTATCC
TTCGAAGTTAAAGGACTAAACCCTAATGATAATAATTTATATTTATTATT
TGATGGAGTAAGATGTGCTATAACACCTGCAACTGGCTATAGAAAAGGCT
CTGAAGATGGTACGATAATGACAGATGCTAAAGGAACAGCTAAAGGTAAG
TTTACTATTCCTGCAGGTATTCGTTGTGGTAACCGAGAAGTTACACTTAA
GAATGCTAACTCTACAAGTGCTACAACTTACACAGCCCAAGGACGTAAAA
AAACCGCTCAAGATATTATATCAGAACTCGTGTAACAGTAAACTTAGTA
GACCCGTTAGCACAATCATTCCAATATGATGAGAATAGAACTATATCATC
ATTAGGATTATACTTTGCTTCTAAAGGTGATAAACAATCTAATGTTGTTA
TCCAAATTAGAGGTATGGGTGACCAAGGTTATCCTAATAAAACAATCTAT
GCAGAAACAGTTATGAATGCTGATGATATTAAAGTATCTAATAATGCTAG
TGCTGAAACTAGAGTATACTTTGATGACCCTATGATGGCTGAAGGCGGTA
AGGAGTACGCTATTGTTATTATTACTGAGAACAGTGATTATACAATGTGG
GTAGGTACTAGAACTAAGCCTAAAATTGATAAACCTAATGAGGTTATTTC
AGGTAATCCATACCTACAAGGTGTATTATTCAGTTCATCAAACGCATCAA
CATGGACTCCTCACCAAAACTCTGACCTTAAATTTGGTATTTATACTTCT
AAATTTAATGAGACAGCAACGATTGAATTCGAACCAATTAAAGATGTATC
AGCGGATAGAATAGTTCTTATGTCTACGTACTTAACTCCTGAGAGAACAG
```

-continued

```
GATGTACGTGGGAAATGAAATTAATTCTAGATGATATGGCATCTTCTACA
ACATTCGACCAATTGAAATGGGAGCCTATCGGTAACTATCAAGACTTAGA
TGTTTTAGGTCTAGCAAGACAAGTTAAGTTAAGAGCAACTTTCGAATCTA
ATAGATATATCTCACCATTAATGAGCTCTAGTGATTTAACATTCACTACA
TTCTTAACAGAGTTAACAGGTTCATATGTTGGTAGAGCTATTGATATGAC
AGAGGCTCCTTACAATACAGTAAGATTTAGTTATGAAGCTTTCTTACCTA
AAGGTACTAAAGTTGTTCCTAAGTATTCTGCGGATGATGGAAAAACTTGG
AAAACATTTACTAAATCCCCTACAACTACTAGAGCCAATAATGAGTTTAC
ACGCTATGTCATTGACGAGAAAGTAAAATCATCAGGAACAAATACTAAAC
TACAAGTTAGATTAGATTTATCAACTGAAAATAGCTTTTTACGTCCTCGT
GTTCGTAGACTTATGGTTACTACTAGGGATGAATAAACTAGAGGGGTTGA
TTGACCCCTCTTTATTTAATAAGGAGAGATTTATATGCCTAGAGAAGTTA
GAGACCCTTATTCTCAAGCTAAATTATTTATACCTACAGTTGAGGAAAAA
TCAATTAAGGAATTAGAAAAAACATACAAAGAAAAAATTGATGAAGCTAC
TAAGTTAATCAATGAATTAAAGAAAGAGAGAGGAGAAAAATAGATGGCAT
TTAACTACACGCCTCTTACTGAAACACAGAAGTTAAAAGATATGTATCCT
AAAGTTAATGATATAGGTAACTTTTTAAAAACAGAAGTTAACCTTAGTGA
TGTAAAACAGATATCACAACCCGACTTTAATAATATTTTAGCATCTATAC
CTGATAGTGGTAACTATTATGTAACTAATTCAAAAGGTGCTCCTAGTGGA
GAAGCTACAGCAGGATTTGTAAGATTGGATAAAAGAAATGTAAATTATTA
TAAAATTTACTATTCACCATATAGCAGTAACAAAATGTATATCAAGACTT
ATGCTAATGGTACTGTATATGATTGGATTAGTTTTAAATTAGATGAAGGT
AGCTTATACAATGAAGGTAATACTTTGAATGTAAAGGAACTTACTGAATC
CACAACTCAATATGCAACACTAGTTAATCCTCCAAAAGAGAACTTAAATA
CAGGTTGGGTTAATTACAAAGAAAGTAAAAATGGTGTTTCTTCTTTAGTA
GAATTTAACCCGGTTAACTCCACTTCAACTTTTAAGATGATAAGAAAGTT
ACCAGTACAAGAACAAAAGCCTAACTTATTGAAAGATAGTTTATTTGTTT
ATCCTGAAACTAGCTATTCTAATATTAAAACAGATAACTGGGATACGCCT
CCATTTTGGGGATATTCTTCTAATAGTGGTCGTTCAGGAGTTAGATTTAG
AGGAGAGAATACAGTACAGATAGATGATGGGTCTGATACGTACCCTTCAG
TAGTTTCTAATAGGTTTAAAATGGGTAAAGAACTTTCTGTAGGTGATACT
GTAACGGTATCAGTATATGCTAAAATTAATGACCCTGCTTTACTTAAAGA
TAACTTAGTTTACTTTGAATTAGCAGGATACGATACTGTAGATGATACTA
GTAAAAATCCTTATACAGGAGGACGTAGAGAAATAACAGCAAGTGAGATA
ACAACTGAGTGGAAAAATACTCTTTCACATTCACTATACCTGAAAATAC
AATCGGAGCATCAGGCGTTAAAGTTAATTACGTATCTTTACTACTAAGAA
TGAATTGTTCATCTAGTAAAGGTAATGGTGCTGTAGTATACTATGCCTTA
CCTAAATTAGAAAAATCATCTAAAGTTACACCATTTATTACACATGAAAA
TGATGTTCGTAAATATGATGAGATTTGGTCTAATTGGCAAGAAGTTATTA
GTAAAGATGAATTAAAAGGTCACTCCCCTGTAGATATTGAATATAATGAT
TATTTTAAATATCAGTGGTGGAAATCTGAAGTTAATGAAAAGAGTTTAAA
AGATTTAGCTATGACAGTACCTCAAGGATATCATACATTTTATTGTCAAG
GCTCTATTGCCGGGACGCCTAAGGGACGTTCTATTAGAGGAACCATTCAG
GTAGATTATGACAAAGGTGACCCATATAGAGCTAATAAGTTTGTTAAATT
ATTGTTTACTGACACAGAGGGTATTCCTTACACATTATATTATGGTGGTT
ATAACCAGGGTTGGAAACCCTTAAAGCAATCAGAAACTTCTACTTTACTA
TGGAAAGGTACTTTAGATTTTGGGTCTACGGAAGCTGTTAACTTAAATGA
CTCATTAGATAATTACGATTTAATTGAGGTAACTTATTGGACTCGTTCAG
CAGGACATTTTCTACAAAAAGATTAGATATAAAAAATACATCAAATTTA
CTGTATATTAGAGATTTTAATATTTCAAATGATAGTACAGGTTCTAGTGT
AGACTTTTTTGAAGGGTATTGCACTTTTCCTACTAGAACATCAGTACAAC
CTGGTATGGTAAAATCTATAACTTTAGACGGGTCTACAAATACAACAAAA
GTAGCATCATGGAATGAAAAGGAACGTATAAAGGTATACAATATTATGGG
AATTAATAGAGGATAAAGAAAGGTGGAATAAAAAAACTATGGCTGTTAAA
TATGATATAGGTAATAATGAGATAGTATTACATTTAAGAGAAGGTAAATA
TATAACAGGGTTTACAACAGTAGGAGGGTATGATAAGGAGTTAGGACAAG
TAAAAGTTAATAGAGAAATCTTACCTGCTTACTTCTTTGATAATTTTGCC
TATGAAAGATATTTGTATTATAGTAAACCTGAAGAGGTTATAGAAAATAA
AAACTATGTACCACCACAAATCAATGATGATGATGAGGAATCCCAACAAA
TTACTGTACCTAAAGAACAATATGATAGTTTAAAAGAAGAACTAGAGCTT
ATGAGAAAACAACAAGAAGCTATGATGGAAATGCTTCAAAAGCTCTTAGG
TCAAAAGGGGTAATTATAAATGGCATTAAATTTTACTACAATAACGGAAA
ACAATGTTATTAGAGACCTGACTACTCAGGTCAATAACATTGGAGAAGAA
TTAACAAAAGAAAGAAATATATTTGACATTACCGATGATTTAGTTTATAA
TTTTAATAAATCACAGAAAATTAAACTAACTGATGATAAAGGATTAACTA
AATCTTATGGAAACATAACAGCCCTTAGAGATATAAAAGAACCTGGTTAT
TACTATATAGGTGCTAGAACATTAGCAACATTATTAGATAGACCTGATAT
GGAATCTCTTGATGTTGTTTTACATGTAGTACCTCTTGATACTTCTAGTA
AGGTAGTTCAACATTTATATACACTATCTACTAACAATAACCAAATTAAA
ATGTTATATAGATTTGTCTCAGGAAACTCTAGTTCAGAATGGCAATTTAT
TCAAGGATTACCTAGTAATAAAAATGCTGTTATATCAGGAACTAATATTT
TAGATATAGCTTCACCAGGTGTTTACTTTGTTATGGGAATGACAGGAGGA
ATGCCTAGTGGAGTAAGCTCCGGATTTTTAGACTTAAGTGTAGATGCTAA
TGATAATAGATTAGCTAGACTAACTGATGCTGAAACCGGTAAAGAATATA
CTAGCATTAAGAAACCTACAGGAACATACACAGCCTGGAAAAAGAATTT
GAGCCAAAAGATATGGAGAAATATCTACTAAGTAGTATTAGAGACGATGG
TAGTGCATCATTCCCACTCCTAGTTTATACTAGTGATAGTAAAACATTTC
AACAAGCTATTATAGACCATATAGATAGAACAGGTCAAACAACCTTTACT
TTCTATGTTCAAGGCGGTGTATCCGGTTCCCCTATGTCGAATAGTTGTCG
AGGGTTATTCATGTCAGACACACCTAATACTTCTAGTTTACATGGTGTTT
ACAATGCTATAGGTACAGATGGTAGAAATGTAACAGGTTCAGTGGTAGGT
```

-continued

AGTAATTGGACTTCACCAAAAACATCCCCTTCTCATAAAGAATTATGGAC
AGGAGCACAATCATTCTTATCTACAGGAACTACTAAGAATTTATCAGATG
ATATTAGTAACTACTCTTATGTAGAAGTTTATACTACACATAAGACAACA
GAGAAGACTAAAGGTAATGACAATACAGGAACTATATGTCATAAGTTTTA
TTTAGATGGTAGTGGAACTTACGTTTGTTCAGGTACATTTGTTTCCGGGG
ATAGAACCGATACAAAACCCCCTATCACGGAGTTTTATAGAGTAGGTGTA
TCTTTTAAAGGTTCTACATGGACTCTTGTAGATAGTGCAGTACAAAATAG
TAAAACTCAATACGTTACAAGAATTATAGGTATTAATATGCCATAGACTA
GGAGAAATTTCCTAGTCTTTTTTTTCTTGACTTGAAAAGGATTCTGTGG
TATACTATAACTCGTGTAAGGATATAAGGAGATTAAAATGAGATTAAGAA
TTAAGAACTTATATACCTATGTAGAATTTGAGGAGGATGATAAATACTTA
AAAGATATATTTTAAAGAGAGTCCATACGACTATAGGAGCAAGACAAGA
AGGATTTCAGTACAGCCCTGCGTACAAAAGAGGTAGTTGGGATGGTTATG
TAGATTTTTATGTTTATGAGGAAGATAAATTCCCCACTGGACTTTTATTT
AAAATTGAGTTATTATTAGGTGAGCTACAATCAAGGTATAATTTCCAGTT
TGAAACAATTGATGAGCGTGATGAAAGTTTCTTATCTGAAGAAGATATTG
ATGATGAGATAACATTGCTTGATAATAATGTCGGTCAAATTACCTTAAGA
GATTACCAATATGAAGCAGTGTACAATAGCTTAACATTTTACAATGGTAT
TGCTCACTTAGCTACTAATGGTGGTAAAACTGAGGTTGCTAGTGGTATTA
TAGACCAATTATTACCTCAATTAGAAAAAGGTGAGAGAGTAGCATTCTTC
ACAGGCTCTACGGAGATATTCCATCAGTCTGCAGATAGGCTCCAAGAGCG
TTTAAATATTCCTATTGGTAAAGTAGGTGCAGGTAAGTTTGATGTTAAGC
AGGTTACAGTTGTAATGATACCTACTTTAAATGCAAACCTTAAAGACCCA
ACACAAGGGGTAAAGGTTACGCCTAAACAAATATTAGTAAAAGATTGC
TCAAGAGATATTACCTAAATTTGAAGGTGGAACAAATCAAAAGAAATTAC
TAAAAGTATTACTTGATAACACAACACCTAAAACAAAAGTAGAACAAAAT
GTATTAAGTGCCTTAGAGATAATTTACCAAAATAGTAAGACAGATGCAGA
AGTTTTATTAAACTTAAGAAATCATAATGCACATTTTCAAAAAATTGTTA
GAGAAAAGAACGAAAAGAAATATGATAAATATCAAGATATGAGAGATTTT
TTAGACTCAGTTACAGTTATGATAGTTGATGAGGCACACCATTCTAAATC
TGATTCTTGGTACAATAATTTAATGACATGTGAAAAAGCTTTATATCGAA
TTGCATTAACAGGGTCTATAGATAAAAAAGATGAATTACTTTGGATGAGA
TTGCAGGCGCTATTCGGTAATGTTATTGCACGAACTACTAATAAGTTTTT
AATTGATGAAGGTCATTCTGCTAGACCAACAATAAATATTATACCTGTAG
CTAATCCTAATGACATAGATAGAATTGATGATTATAGGGAAGCTTACGAT
AAAGGTATAACAAATAATGATTTTAGGAATAAACTTATTGCAAAACTAAC
AGAAAAGTGGTATAATCAAGATAAAGGTACATTGATTATTGTAAACTTCA
TTGAACATGGAGACACAATATCAGAAATGTTAAATGATTTAGATGTAGAG
CATTACTTCTTACATGGAGAAATAGACTCTGAAACTAGGAGAGAAAAATT
AAACGATATGAGAAGTGGTAAGCTTAAAGTAATGATAGCTACATCACTTA
TTGATGAGGGTGTAGATATATCAGGTATTAATGCACTAATATTAGGTGCA

-continued

GGAGGTAAGTCATTAAGACAAACATTGCAACGTATTGGTCGTGCTTTACG
TAAGAAAAAAGACGATAATACAACACAAATATTTGATTTTAATGATATGA
CAAATAGATTTTTATATACTCATGCTAATGAGCGTAGGAAAATTTATGAA
GAGGAAGATTTTGAAATAAAAGACTTAGGAAAATAGGAGGGTAAGAGATG
GCAACAAAAACACAAAGAAAGCTATACCAATATCTAGAGGAAAATGCTAC
AGAAAATAAATTTCATATTTCTACTAAGAAAGAGCTAGCAGATTCTCTAG
GTGTTTCCATCTCTGCTTTATCCAATAACCTTAAAAAGTTAGAAGAAGAA
AATAAAGTCGTTACTGTTTCTAAAAGAGGAAAAAACGGCGGGGTAATAAT
AACTTTAGTTAGAGAGTATGACACAGAAGAATTGAAAGAATTCAATAATT
CTACAGATAATATTATTACTTCCGATTTACAGTATGCTAAGGCATTAAGA
GAAAAGCACTTCCCTTCTTATAGATATGAGAGAAAAGAACAACGTAGACG
TACTAAGATAGAAATGGCACAATACAATGCCATTAAGGATGAGAAGAGAA
GAATTATAGCAGATATGAATTTCTATTCAGAAGGTCTTCCTTATCCTTCT
AAAGATATTTTTAATATGTCCTATGACCCGGAAGGGTTTTATAAAGCGTA
CATCTTATGTAAGTTATACGACCAATATGCTATTTCTCATATGGATGCTA
AACATACAAGTCATCTTAAAGCAATGAGTAAGGCAACAACTAAAGATGAA
TACGACTACCATCAACATATGTCTGAATACTATAGAAATAAAATGATTCA
AAATTTACCTAGAAATAGCGTTAGTGATAATTTCTTTGGTAGTAAAATGT
TTAATACTTTTTATAATTTTTATTTAAAAATAAAAGATAAAAATATTAAT
GTATTTAAGTATATGCAAAATGTATTTAAAAATGTAACATTTTATTACGA
GAACGGTATGCAACCTAATCCAATACCTTCTCCTAACTTCTTTAGCTCAG
ATAAGTATTTTAAAAACTATAATAATTATATTAAAGGAATAAAAAAAGGT
GTTAACAGTACTAATAGACACCTAGGTGATACAGACAGCATCATTAATTC
ATCAGACTATGTGAAAAACCCTGCTGTATTACATCTCACACCAACTATATA
CTACAGGATTAAATTCTACTTTACATGATATTGATACTATGTTTGAACAA
GCCTTAGACCTTGAAAATGCCTCCTATGGATTATTTGGAGATATGAAACA
TATTATTTTACTACAGTATAATTCTATGATTGAAGAAGAAATTAAGAATT
TACCTAGAGAAGAAAGGATATTATTAATAAATATGTAAAACAATGCATA
ATTAATGATTATTCACCAACAAGTATTTCACCTTCTGCAAGGTTATCAAT
GTTTACTATGCAGAAAGAGCATATAGTTTACAATAAGCAGTTAAATAAAG
GAATCAAGAGAGAGGATTTATTACCATTAAGTCTAGGAGGTATAGTGAAT
AAAGATTTATTGAGTGGTATGGATATACAAAACTTAGAACAGAATGGTAA
TGAATACCTATATATGAGACAACATACTTCAACTTATTATATATTAAGAA
TGTTTGGTGACTATTTAGGGTATGAGGTAAACTTAAGAGAAGTAAAATAT
ATTGTAGAGAAATATAATTTAATTGATAAAATACCATTGACAAAAGAGGG
TATGTTGGATTATAATAAACTTATACATTTAGTAGAGGAAGAGGTTAATA
ACTATGAGTAAGAAGATAAAGGAGCTTATCCTTCATAAATCAATGAAGGA
TATACATTTTGCAAGAGAAGTATTAGATAACTTACCTAAGAATCTATTTT
CAGCAGAGTCTGAGGACATGGGTTACTTATTTACAGCTATAAAGAGAACA
GCACATATTTCCGATAAGATGTCAAATGAAGCATTAGCAATTAAAGTAGA

-continued

```
ACAGCTTATGGGTAATAATAAGGAAGATGAAGAGAAAGTAACCAAGACAT
TAACTTACTTAGAAGATTTATATAAAGTAGACGTTAATGAAAAAGATGAA
TCTGTTAATTATGAAATAGAGAAGTATATTAAAACAGAAATGTCAAAGA
AGTTTTAGTTAAATTTATTGCAGAAAATAAACAAGAAGACTCTGATAATC
TACATGAACTTGTAGACAAACTAAAGCAAATAGAAGTAAGTGACATCTCA
GGAGGTAATGGGAGTTTATTGACTTCTTCGAAGATACAGAAAAGAAACA
AGAACTATTGAGTAATTTAGCTACAAATAAATTCTCTACTGGATTTACTT
CTATTGACAACCATATTGAAGGTGGTATAGCAAGAGGAGAGGTTGGATTA
ATCATAGCTCCTACCGGTAGAGGTAAATCATTAATGGCTTCAAACTTAGC
TAAGAATTATGTTAAAAGTGGATTAAGTGTTTTATATATTGCCTTAGAGG
AAAAAATGGATAGAATGGTTTTGCGTGCTGAGCAACAAATGGCAGGAGCA
GAAAAGAGTCAAATTGTAAATCAGGATATGTCTTTAAATAATAAAGTTTA
TGATGCAATACAAAATCATTATCAGAAGAATAGAAAGTTATTAGGTGACT
TTTATATTTCTAAACATATGCCAGGTGAAGTTACACCAAACCAATTAGAA
CAAATTATTGTCAATACAACAATTAAGAAGGATAAAAATATTGATGTTGT
TATTATTGACTATCCTCACTTAATGAGAAATCCTTATGCTAAATATCATT
CAGAATCAGATGCAGGAGGGAAATTGTTTGAAGATATTCGTAGATTATCA
CAGCAATATGGATTTGTTTGTTGGACGTTAGCTCAAACTAACCGTGGTGC
TTATGGTTCAGATGTTATTACAAGTGAGCATGTAGAAGGTTCTCGTAAGA
TTGTCAATGCTGTTGAGGTGTCTTTAGCAGTAAACCAAAAAGATGAAGAA
TTCAAGAGCGGTTTCTTAAGATTGTATTTAGATAAAATTCGTAATAGCTC
TAACACAGGAGAACGATTTGTTAATCTTAAAGTAGAACCAACTAAGATGA
TTGTAAGAGATGAAACACCTGAAGAAAACAAGAGCATATACAATTGCTA
TCAGATAATGGAAAAGAAGACACAAGTAAATTTCAAAATAAAGATAATAA
AATAGAAGCTATAAATAACACATTCGGAGGATTACCGGGAGTTTAATTTT
TTAAAATATACCACTTGACATTTTATATGTTAGGTGGTATAATTATTTTA
TAAAGAATAAAGGAGAGATTAATAATGAAATTTGTATTCTTTACAGATAG
CCACTTTCACTTATTTACTAACTATGCTAAACCTGATGAGCAGTATGTGA
ATGATAGATTTAGAGAACAGATACAAGCTTTACAGAAAATGTTTGATATT
GCAAGAGAAGAGGATGCAACAGTTATATTTGGTGGGGATTTATTCCACAA
ACGTAACGCAGTAGATACTAGAGTATATAATAAGGTATTTGAAACATTCC
AACTTAATAGAGATATAGAAGTACTAATGTTAAGAGGTAATCATGATTCA
GTTACAAATAGTTTATATACAGATTCTAGTATAGAACCTTTCGGTTACTT
ACCTAATGTAGAGGTTTGTAAAAACCTTGATACTTTAGGGTTTTTAGGAG
AAGAACAGGATATTAATATTGTTATGGCTCCTTATGGAGACGAGACTGAA
GAAATTAAAGAGTTTATTAAAAATAAATATGTAGAAGATAGAGTAAATAT
CTTAGTAGGTCATTTAGGTGTAGAAGGCTCTTTGACTGGAAAAGGGTCTC
ATAGATTAGAAGGGGCATTTGGATACCAGGATTTATTACCTGATAAATAT
GATTTCATTTTACTAGGTCATTATCACCGTAGACAATATTTCCAAAATCC
GAATCATTTTTATGGTGGTTCATTAATGCAACAATCATTTTCTGATGAGC
AAGAAGCTAATGGTGTTCATTTAATAGATACAGAAAAAATGACTACAGAA
TTCATCCCAATCCATACACGTAGATTTATTACTATTCAAGGAGAAGATAT
TCCTGAGAACTTTGAACAGCTAATCGAGGAAGATAATTTTATTAGGGTTA
TCGGTACAGCAAATCATGCTAAGGTTTTAGAAATGGATGACAGTATGAAA
GATAAGAATGTTGAAGTTCAAATTAAAAAAGAGTATACTGTAGAGAAACG
TATTGATAGTGATGTGTCTGATGACCCTTTAACAATTGCTAGTACCTATG
CTAAACAATACTCACCTGAATCAGAACAAGAAATACTTGAGTGTTTGAAG
GAGGTTTTATAATGAAAAATATAGAGAATATCTAAATAAGACAGATGCA
GAAAATTTAGCAGAGGATTGGGAGAAAGTAACCGAAGATTTATGGAAAGT
GTTTAAAGATATGAAACCTAAAATTAATACATTAGATATCAGTAATGTAG
TAAGTAAAGACTTAGATAAAAGTAAACCTATTTTACAATTCCAAGATTCA
GATGGAGTAATAGAGAATATTTGTAATGTTGAAGGTTTAGAAGATGGTCT
AAGTAAAATGAAAAAGATTTTTGATGATAGTAATTTTGAAAAGCATTATT
ACAATAGAGTAGTAGACCATGATGAGTATTACTGGATTGATTATGGCTCT
CATCATTGTTTCTTTAGAGTTACGAAAGGGGATAAGTAATGGTTGTATTT
AAACAAGTAGAAGTTAATAATTTTTTAGCAATTAAAGAAGCTACGCTAGA
GTTAGACAATAGAGGATTAATTCTAATTGAACGTGAGAATAAATCTAATG
AGTCATTTCATTCAAACGGCTCAGGAAAATCAACTTTAATATCTGCCATT
ACTTACGCTTTATATGGTAAAACTGAAAAAGGACTAAAAGCAGATGATGT
AGTAAATAATATTGAGAAGAAAAATACATCTGTTAAACTTAAGTTTGATA
TTGGGGAAGATAGTTATTTAATTGAACGTTATCGTAAAGATAAAGAGAAT
AAGAATAAAGTAAAATTATTCGTTAATGAAAAAGAGATTACAGGTTCAAC
AAATGACGTTACCGATAAACAAATACAAGATTTATTTGGTATTGAGTTTA
ATACTTACGTTAATGCCATCATGTATGGTCAAGGAGATATCCCTATGTTC
TCTCAAGCAACAGATAAAGGTAAGAAAGAAATTCTTGAATCTATTACTAA
GACAGACGTATATAAACAAGCACAAGATGTAGCAAAAGAGAAAGTTAAAG
AAGTGGAAGAACAACAAAATAACATAAGACAGGAAATCTATAAACTAGGT
TATCAGTTATCGACAAAAGATGAGTACTTTCAAAGAGAAATAGAGCAGTA
CAATCAATATAAAGAACAATTGGTTCAGATAGAAAACAGTAATAAGGAAA
AAGATAGATTAAGAGAACAAGAGGAGAAGCAAATAGAAGCTCAAATAGAG
CAACTAGCTTCACAGATACCAACAATACCTGAAGATGAATTTAAGCACTC
AGAGGAGTATAATAAAGCCTCTCAAAGCCTAGATTTACTTTCTAATAAAT
TAACGGAGTTAAATCAAGTTTACTCAGAGTATAATACCAAAGAACAAGTA
CTAAAATCTGAAATAGCTACATTAAGCAATAGTCTAAATCAGTTAGATAC
AAATGACCATTGTCCTGTTTGTGGCTCCCCTATAGATAATTCTCATAAAT
TAAAAGAACAGGAAATATCAATAATCAGATTGAGAATAAGAAACAAGAG
ATTACTAGTGTATTAGAAATGAAAGATACGTATAAAGAAGCTATTGATAA
AGTAAAAGATAAATCACAAGAAATTAAAGATAAAATGTCACAGGAAGACC
AACAAGAACGAGAGCACAATAATAAGATTAACAGCATAATTCAAGAGGCT
TCTAGGATTAAATCAGACATTAGTTCATTAGAGAATAATAAAACGTATTT
AAAAGTTAAATATCAACATCAATCTGTTCAAGGATTAGAGAGAGAAGAAC
```

-continued

CAAGTAAAGAAAAACATGAGGAAGATAAGAAAGAATTACAAGAATCTATT
GACAAACATGAAGAGAATATAGTACAATTAGAAACTAAGAAAGGTAAATA
TCAGCAAGCTGTAGATGCTTTTAGTAATAAAGGTATACGTTCAGTAGTGT
TAGACTTTATTACACCATTCTTAAATGAAAAAGCAAATGAGTACCTTCAA
ACTTTATCAGGTTCAGATATTGAAATAGAGTTCCAAACTCAAGTGAAGAA
TGCTAAAGGAGAACTAAAAGATAAGTTTGATGTTATTGTTAAGAATAGCA
AGGGCGGAGGTTCGTACAAATCCAATTCAGCAGGAGAACAAAAACGTATT
GATTTAGCAATTAGTTTTGCAATTCAGGATTTAATTATGAGTAAAGATGA
GATATCTACGAATATTGCACTTTACGATGAGTGTTTTGATGGATTAGATA
CTATCGGTTGTGAAAACGTGATTAAATTATTAAAAGATAGACTTAATACA
GTAGGAACAATATTTGTAATTACTCATAATACCGAGCTTAAACCACTGTT
TGAACAAACAATTAAAATCGTAAAAGAAAATGGAGTATCAAAACTGGAGG
AAAAATAATGAAATTAAAGATTTTAGATAAAGATAATGCAACACTTAATG
TGTTTCATCGTAATAAGGAGCACAAAACAATAGATAATGTACCAACTGCT
AACTTAGTTGATTGGTACCCTCTAAGTAATGCTTATGAGTACAAGTTAAG
TAGAAACGGGGAATACTTAGAATTAAAAAGATTACGTTCTACTTTACCTT
CATCTTATGGTTTAGATGATAATAACCAAGATATTATTAGAGATAATAAC
CATAGATGTAAAATAGGTTATTGGTACAACCCTGCAGTACGCAAAGATAA
TTTAAAGATTATAGAGAAAGCTAAACAATATGGATTACCTATTATAACAG
AAGAATATGATGCTAATACTGTAGAGCAAGGATTTAGAGATATTGGAGTT
ATATTCCAAAGTCTTAAAACTATTGTTGTTACTAGATACCTAGAAGGTAA
AACAGAAGAAGAATTAAGAATATTTAACATGAAATCAGAAGAGTCACAAC
TGAATGAAGCACTTAAAGAGAGTGATTTTTCTGTAGATTTAACTTATAGT
GACTTAGGACAAATTTATAATATGTTGTTATTAATGAAAAAAATTAGTAA
ATAGTAAGGAAGGATATTATGAGGTTTGAAGACTTTTTAACCCAAGAATT
AGGAGAACCAAAAGAAAATACTATAGGTGAGCTAAGATACTGTTGTCCGT
TTTGTGGAGAAAAAAGTTATAAGTTCTATGTTAAGCAAGCCCTAGACTCT
AGTAATGGTCAGTATCATTGTAAAAAATGTGATGAATCAGGTAACCCTAT
TACATTTATGAAGACTTATTATAACATTACAGGTAAACAAGCTTTTGATT
TATTAGAGTCTAAGAATATAGATATAGAGAGCCCCTTTACTTACGACC
AATAATAAGGATTTGACAGAATCAGAGAAACTTATATTAATGCTTAGAGG
TGTGCACCAAGATAAAGGAAATACTAGTATTAAACCTCCTAGATTACCTG
AAGGGTATAAATTATTAAAAGATAACTTAAATAATAAAGAGATTATACCC
TTTTTAAAATACTTAAAAGGTAGAGGTATAACTTTAGAACAAATCATTAA
TAACAATATAGGTTATGTTATTAATGGGAGGTTTTATAAAGTTGAGGGGG
AATGGAAAGTATGATTAAGGAATAGTATTATATTTTTAGTTATGATAAT
GATGGAAACTACCAGTACTGGAATACAAGAAGTATAGAGAAGAACCCTTA
TATTAAATCTATTAATGCTCCTGCTAAACAAGATGAAGTAGGGAGAAAAG
ATGTCATATTTAATTTGAATATAGCAAGAAAGAAAAAGTTCTTAGTTATA
ACTGAGGGTGTATTTGATGCTTTAACCTTCCATGAGTATGGAGTAGCAAC
ATTAGGTAAACAAGTAACCGAGAATCAAATAAAAAAAATAATTGATTATG

-continued

TTAGTATAGATACATCAATATATATTATGTTAGACACTGATGCACTAGAT
AATAATATAGACTTAGCTTATAAGTTAAAAACACATTTTAATAAAGTTTA
CTTTGTACCTCATGGTGATGAAGATGCAAATGATATGGGGACAAGGAAAG
CCTTTGAGTTATTAAAACAGAACCGGGTGTTAGTAACACCTGAAAGTATA
CAGAGTTACAAAATACAACAAAAACTTAAACTTTAGGCTTGACCTTAGAG
AAGTTTTATGTTATACTAGTAATTAAGTAATTAATAAAGGAGAAAAAAAA
TAATGTCAAATAATAAAAAAGATATTTTAGAATTTGTAGATGAATACATT
ACAGCTTTAAGAGTTGGTAATGAGCAACGACAACATCAATTAGAAGAAAT
GGGTAAAGAAGAAACAGCAACATTAACAGATGTAGCTAAAGCTATTACTA
ACCTTATGTTAGGTGTTAATGAGCAGATGACAGACTTAGAATATAATAAT
GAGTTAAACTTAAATATTTTAATTGACGCTTTATATAAAGCAGAGCTTAT
TAATGAAGATGTATTAGACTACATTCAAGAATCAATTGATAAATCACAAG
AAGAACCTAAAAATGAAGAAGAAAAAGGAGAACAAGAATAATGGAAAAAA
ATATTAGCACACACACAAAAGGTATTAGTCAAGCAGACATGGAGAAATGG
ATTGAAGCTGCAGTACAAGGAACTGTTGATGGTAAACAAGTTGATGAGAA
AACAGCTAAACAATTAGATAGAATTGGTTCACGTAGTGTTTCTTTAGAAG
AAGCAACTCGTATTGCTAAAGTTCTTAATGCTGTAACAGCTCAAGAGGTT
ACAGGAGACTTTAATGATGCATTTAATGCAATTGACTTAATGATGATTAT
CATGGAAGATGAGTTAGGAGTAACTCAAGAAAAAGTAGGGAAAGCTAAAG
ATAAACTAAATGAAAAACGAGAAGCTTACCTAAAAGAGAAACAAGAAGAA
TTACGTCAAAAACAACAAGAAGAGGCACAGAAAAAAACTGAATCTGACAG
CAATGAAAAGTAATTCAGTTGAAGAAAAATGACGAACAGTAAGAAAAAA
GGGGATACATTCGAACGTAAAATAGCTAAAGAATTAACTTCTTGGTGGGG
ATACCAATTCAATAGGTCTCCTCAATCAGGTGGTGCTTCATGGGGTAAAG
ATAATAATGCTGTCGGAGATATAGTAGTACCTCAGGAAGCTAATTTTCCT
TTAGTAGTAGAATGTAAACATAGAGAAGAATGGACTATAGATAATGTTCT
TCTAAACAACAGAGAGCCACATACATGGTGGGAGCAAGTCATTAATGATA
GTAGCAAGGTGAATAAGACACCTTGCTTAATATTTACTAGAAATAGAGCT
CAGAGTTATGTTGCTTTACCTTATGATGAAAAAGTATATGAAGATTTAAG
AAATAATGAATACCCTGTCATGAGAACAGATTTTATTATTGATAATATTA
GAAAAGATAAATTTTTTATGATGTCCTTATAACTACCATGAATGGGTTG
ACCTCATTTACACCTTCTTATATTATATCTTGCTACGACAAAAAAGATAT
AAAACCATACAAGAAGGTCGAGTCTAATTTATCTGAGGTAAGTAAGCATG
AAGATGAATTGATTAATGACCTTCTTAGTGATATATAAGGAAGGTAAGAT
AAGTATGACAAGTAAAGAAAGACCATTAATCGTATATTTTTCAGGTACAG
GACAAACAGAAAGATTAGTAAACAAAATTAATATTAATAATTCATTTGAA
ACATTTAGGGTTAAGAGTGGAAAAGAAAAAGTAAATAAACCTTTTATACT
AATAACACCTACTTATAAGAAAGGTGCAATACCTAAACAAATAGAAAGAT
TCCTAGAAATTAATGGGAGCCCTAAAGAAGTTATTGGTACAGGAAATAAA
CAATGGGGCTCTAATTTCTGTGGAGCAAGTAAAAAGATTTCAGAGATGTT

-continued

```
TAAGATTCCTTTAATTGCTAAAGTAGAGCAATCAGGACACTTTAACGAGA
TACAACCAATATTAGAACACTTTAGTAATAAATATAAAGTAGCGTAAAGG
ATGAGAGATATATGGCAACATATGGAAAATGGATTGAGTTAAATAATGAA
ATAACTCAATTAGATGACAATGGAAAAAATAAACTCTATAAAGACCAAGA
AGCTTTAGATGAGTATTTAAAATATATTGAAGACAATACAAGAAAGTTTA
ATAGTGAAGTAGAAAGAATTAGAGTATTGACAAAAGAAGGAACATATGAT
AAAATATTTGACAACGTTCCTGACACTATTATTGATGAAATGACTAAGTT
AGCTTACAGTTTTAATTTTAAATTCCCTAGTTTCATGGCAGGGCAAAAGT
TTTATGAATCTTACGCATCAAAACAGTATGATGAAAACAAAAAACCTATT
TTTGTTGAAGACTATGAACAACATAATGTTCGAGTAGCTTTATATTTATT
TCAAAATGACTATGTAAAGGCTAGAGAATTACTAGTACAACTTATGGAGC
AAACATTCCAACCATCTACACCTACGTATAACAACTCAGGACAAGCTAAT
AGAGGTGAACTAAGCTCATGTTATCTATTTGTAGTAGATGATTCAATTGA
GTCTTTAAACTTTGTTGAAGATAGTGTAGCTAATGCTAGTTCTAATGGTG
GTGGAGTTGCAATTGATTTAACTAGAATTAGACCTAAAGGAGCTCCAGTA
CGTAATAGACCTAATTCAAGTAAAGGTGTTATTGCTTTTGCTAAAGCTAT
TGAACATAAAGTTAGTATTTATGACCAGGGTGGTGTAAGACAGGGTAGTG
GTGCTGTTTACCTAAATATATTCCACAATGATATCTTGGATTTATTAAGC
TCTAAGAAAATCAATGCCAGTGAGTCTGTTAGACTAGATAAATTATCTAT
TGGTGTTACAATCCCTAACAAATTTATGGAGTTAGTTAAAGAAGGTAAAC
CTTTCTATACTTTTGATACTTACGACATTAATAAAATGTACGGTAAGTAT
TTAGATGAGCTAAACATTGATGAATGGTATGATAAGTTACTAAATAATGA
TAGTATCGGTAAAGTAAAACATGATGCTAGAGAAGTTATGACAGACATTG
CTAAAACACAATTAGAATCAGGGTACCCTTATGTATTCTATATTGATAAT
GCTAATGATAATCACCCATTGAAAAACCTAGGTAAAGTTAAAATGAGTAA
CTTATGTACAGAAATTTCACAATTACAAGAGGTATCAGAAATTTATCCGT
ATTCTTACAGTAATCAGAATGTTATTAATAGAGATGTTGTTTGCACATTA
GGTTCTCTTAACTTGGTTAATGTAGTTGAAAAAGGTTTATTGAATGAATC
TGTAGATATTGGTACAAGAGCATTAACAAAAGTTACTGATATTATGGATT
TACCTTACTTACCTAGTGTTCAAAAAGCAAATGATGATATTAGAGCTATC
GGTTTAGGTTCAATGAATTTACATGGACTTTTAGCTAAGAATATGATTAG
TTATGGTTCTAGAGAAGCATTAGACCTAGTAAACAGTTTATATAGTGCTA
TTAACTTCCAATCTATTAAGACATCTATGTTAATGGCTAAAGAAACAGGA
AAACCATTTAAAGGCTTTGAGAAGTCCGATTACGCTACAGGTGAATACTT
TGTAAGATACATTAGAGAATCCAATCAACCTAAGACAGATAAAGCTAAGA
AAGTCTTAGATAAGGTTTATATTCCAACACAAGATGATTGGGATGAATTA
GCTAAAGCAGTGAAAGTACATGGTTTGTATAATGGTTACCGAAAAGCAGA
AGCACCTACTCAATCTATATCTTATGTACAGAATGCTACAAGTTCTATTA
TGCCAGTACCTAGTGCTATAGAGAATAGACAATATGGAGATATGGAGACA
TATTACCCAATGCCTTACCTAAGTCCTATAACTCAGTTCTTCTACGAAGG
AGAAACAGCTTATAAGATTGACAATAAACGTATTATTAATACAAGCGCAG
```

-continued

```
TTGTTCAGAAACATACAGACCAAGCAGTGTCTACAATACTTTATGTAGAG
TCAGAAATACCTACTAATAAACTAGTATCATTATACTATTATGCTTGGGA
ACAAGGATTAAAATCATTATACTATACACGTTCACGTAAACTTTCTGTTA
TTGAATGTGAAACATGTTCGGTTTAGAAAGGAAATAGATATGGATATTAC
ACAAAAAGTAAAACAACATAATAAAAATGCTGTATTAAAAGCAACAAACT
GGAATATTGAAGATGACGGGATGTCTGATATTTATTGGGAGCAAGGAATC
TCCCAATTTTGGACTCCTGAAGAGTTTGATGTATCAAGAGATTTAAGTTC
TTGGAATAGTTTAACTGAAAGTGAAAAGAACACTTATAAGAAAGTCCTTG
CAGGGCTCACAGGGCTCGATACAAAGCAAGGAGGAGAAGGTATGAACTTA
GTATCCTACCACGAACCAAGACCTAAATACCAAGCTGTATTTGCGTTTAT
GGGTGGTATGGAAGAGATACATGCTAAATCGTATAGTCATATCTTTACAA
CATTACTAAGTAATAAAGAAACAAGTTATTTATTAGATACTTGGGTAGAA
GAAAACGACTTTTTAAAAGTAAAAGCTCAGTTTATCGGATATTACTACGA
CCAACTATTAAAACCTAATCCTACTATATTTGATAGATACATGGCTAAAG
TAGCTAGTGCCTTTTTAGAAAGTGCATTATTCTACTCAGGATTTTATTAT
CCTTTACTTCTTGCAGGAAGAGGTCAGATGACACAATCAGGAGCTATTAT
TTATAAAATTACTCAAGATGAAGCTTACCATGGTTCGGCAGTAGGATTAA
CAGCTCAATATGATTATAATCTTCTAACAGAAGAAGAGAAAAAACAACCA
GATAAAGAAACTTATGAATTATTAGATATTCTTTACACTAATGAAGTAGC
GTATACACATAGTCTATATGACCCACTAGAATTAAGTGAAGACGTAATTA
ACTATGTTCAGTATAATTTTAATAGAGCTCTTCAAAACCTTGGAAGAGAG
GACTATTTTAATCCTGAACCTTATACCCTATTGTAGAAAATCAAACTAA
TGTAGACAGATTACGAAATGTTGATTTCTTTAGTGGTAAAGCAGACTATG
AAAAATCTACAAATATCAAAGATATTAAAGATGAAGATTTCTCATTCTTA
GATAGTAAAGAATACAGTACTGCCAAGGAATTCCTATAAAAAGGAGAAAA
GATATTATGGATAGAAAAGAAGCAATGGATTTACTAAGTAAAGCAGAAAT
ATTATTTAAAAAACATGATGAGTTTTCATGTGTAAGTGATATCAATGACC
CTATGAAGTTATTCAGTAACTCTAAGGATGCTAAAGCTGATGATACGTCT
AATTCTTTTCAGCTAGAGTTTATGCATGATATGACCATGTATACTTTATC
TTATGGCTCAGGACAGCTAAAACTTATTGATTTAGCAGAAGGTTATGAAG
CACAAAAAGCTACAATAGTTAACTCATTTCCCGAAATTATTAAAACATTA
GAAAAGGATGATTCAGAAGATGGAAAAAATGAATAGTTTAGTAGATTTAA
ATACAGCAATTAGACAAAAGAAAGATGTTATTGTCATGATTACACAAGAT
AATTGTGGTAAGTGTGAGATTTTAAAAAGTGTAATCCCTATGTTTCAAGA
GTCAGGTGACATTAAAAAACCTATCTTAACATTAAATCTAGATGCTGAAG
ATGTAGATAGAGAAAAAGCTGTTAAGTTATTCGATATCATGAGTACACCA
GTATTAATTGGGTATAAAGATGGTCAGTTAGTTAAAAAGTATGAAGACCA
AGTTACACCTATGCAATTACAAGAATTAGAGTCACTTTAATTTGGAATTT
CCTACTATCTGTGCTATACTATAATAGTACAAGGTAGTAGGATTTTTTAA
TGGAAGGAAGATGACATATCGCAAAGAATAAAACATTAACGATATATAAT
```

-continued

AGTGATAGATATTTTAATATACACACAAAAGATAAAGATAAAATTAATGA
GGCTATTAAAGTAACACACGGTAATGAAGAAGAAATTGAAAAGAATATGG
ATGAATTAATATCTAAGTCTAGAAGATATATCATGAGGGATGAAAAGCAT
TACATGCTATTTAATGAGAAGTACAATAATGATAGGCTTATAGAAAAGT
ATGTAAACACGGTGGTAAAGTTACATACTATACTGATTCAGTATTACCTT
ACTATGTTTTAAAAGACTTATCTAGTCACCCTGACTCAGAAGTTGTTTAT
CGTATGCGCAACGGTTTTACTGCAAAAGAAGTAGATAATATAGCTTTATC
ATTCATGGGTACAAAAGTTATTATTGATATTTCTGTAGTATTTCCTTATG
TAAACCCTTATGATATTATTAGAAGTTTACATGATATTAAAACAAATGTA
GATGAAGTTCATTTATCATTTCCACGAATATTAGGGGTAGATGAAAAACA
AGAAAAGTTTTATTTCTTTGATGGTGAAGCTTATGATTTAAAACCCGAAT
ATAAAGTCGATTTTGCAGATAAAATTAGAGTATCTTTATCAGTATGGAAA
ATGTATATCTATATCTTAACAAGTAGTCGTGATTTTGAGGATGTAGACAA
TGTAATTACGAAATTAAAACAACAACGAAAGATTAAGATATAAGGTGATT
ATATGAGTACAGCAAATAGAAGAGATATAGCAAGAAAGATATCAGAGAAT
ACAGGTTACTATATCCAAGATGTAGAGGAAATACTAAGTGCAGAGACAGA
TGCTATTTCTGACTTGCTAGAAGAAGGGTATACTAAAGTAAAGAATCATA
AATTTATCCAAATAGAAGTTATTGAAAGAAAAGGTAAAAAAGCGTGGGAT
GGTCTGAATAAAGAATACTTCCATTTACCTAATAGAAAAGCTATAAAATT
CAAACCACTAAAAGAACTAGAAGAGGTTATTGATAGACTTAATGAAGAAG
AGAAATAATTCTCTTCTTTTTTATTGACAAGGTTTAAAATATATGGTAT
AGTATTATTAAGTTAAAAAAGGAGAGGAATTAAATGAAAGTATTAATCTT
ATTTGACCACATTAGAAGAGCATTTTTCTGTAAGTAAAGATGGGAGTG
TGAAATCTAATGTACTAAATACACCTAACGGAAAAACACTTAAGAAATTA
CTTGAGAAGTGTTCTAACTTAAAGAGAGATAAAACAAACAGAGATTATGA
TATTGATTTTCTCTACAATGCAGTACCTACACCTATTAGAAATGACTACG
GTAAAATCATTAAATACCAAGATGTTAAACAAGCAGAAGTAAAGCCATAC
TATGAGAGAATGAATAATATTATTATTGATAATTCTTATGATATGGTAAT
TCCTGTAGGTAAACTAGGTGTTAAATACCTATTAAATGTTACAGCTATTG
GTAAAGTAAGAGGTGTACCAAGTAAAGTAACTATTGAAAATGGAACATCT
TCTCATGATGTGTGGGTATTACCTACTTATAGCATTGAATATACTAATGT
AAATAAAAATAGTGAACGTCATGTAGTATCAGATTTACAAACAGTTGGTA
AGTTTGTAGAGCAAGGAGAAGAGGCATTTAAACCTAAGGAAGTATCTTAC
GAGTTGGTAGATAACATTGAAAGAGTAAGAGAAATATTCAATAAGGAAGT
AAAGAATGATAATTATGATGGGGTAGATATTACCGCATGGGACTTAGAGA
CTAACTCATTAAAACCTGATAAAGAAGGAAGTAAACCTTTAGTACTATCT
CTATCATGGAGAAATGGTCAAGGTGTAACTATACCCTTATACAAATCAGA
CTTTAACTGGGAAAACGGTCAAGATGATATTGATGAAGTCTTAGAATTGC
TTAAGAATTGGTTAGCTAGTAAAGAAGATATTAAAGTAGCACATAACGGT
AAATGATTTGCTGTTGTAAAATCCCTCTCATATCGGGCATAGCTTTAAGT
AGCTGATAAGAGAACCTAAGTCCTGTAATAAGGATAGTGGTAATCCCGAG

-continued

CTTACATTATTGGTGACAATAGATGGGGTGTAGAGACTGAGCCGAGGTTT
TGTAGACCAAGGTGAGACATAGTGTATCGACTTAATAGAGGTGGTACAGT
GAAAAAAGATTATATGACATCAGTTAAAAATAACAAAAAAGTATGTAGAA
GATGCAACGAAGAATTAGATTTATCTAACTTTAAAACATATAAGGAAGAAT
GATAAAACTTATTATCAAAGTATGTGTATACCTTGTCGGAAGGAATATAA
TAAGTTAGATAAAACTAAAAATACTATTAAAAAAATGTTATGAGAAAACG
GAGATAAATATAGAAGACAAAGTAATGAGTATAATACTTCTGACAGAGGT
AGAGAGCTTAATAAAAATAGGTCTAGGAAATACAGAGAAAACAATTCTTT
AAAATCGAAAGCTAGAAGCTCTGTAAGAACCGCATTAAGAAATGGTTCTC
TCATAAGACCTGATAAGTGTTCAGAGTGTAATAAAGATTGCATACCTGAA
GCTCACCATCCTGATTATACTAAACCTTTAGAAATAAAATGGTTATGTAA
ATCCTGTCATGAAGATACTCATCATAAAAAATAATCACACTATGTAAATG
AGGGACATCAAGCCCATTTAGGTAACTACAAACAAACCTAATGGTAAGGG
CTTATGAAGGTATAGTCCGTTCTATATAGAAATATATAGGCTAAAACGAA
ATATGATATTAAGTTCTTAATGAGTACTGAAAACTTTAAAGATTTTGAGA
GTATTCAGGATACTAAAGTAGGTTGGTACCTAGCTGTTACCCAAGAAGTT
AAAGAATCTTTAAGATTATCTGATTTAGCTTATGAGGTTACAGATGTCGG
AGGCTATGATAAACCATTAGAAGACTTTAAATTATGGTTTGTTACTAAGT
TATTAAGATTCTTCTCAGATAAAATTAAAGAGATACAGAAAGAAAATAAA
AAGATTGCTAAGAAAGAGTATGATGTTAAAGCTCCTGAATATAAAGAATG
GTTAGAGAATAAATTAAATGAAACAGTAGTAGAACTAGATGATACTGAGA
AAAAATTTAGAGTTAGTGAATTAGAGAAAAAGTATATTCAACTAGGTCTT
TCACCTGAAATTGTAAATATGAATTTAGTTATGGATAATGATGAATTCAT
AAATATTGCAGAACAATCACCTGAGTACATGGGGTTATCTGACTACGCTA
AGTCTTACACGTTAAATACTGCAATTAATTTAATTAATGAGTATAGAGAT
GTAAAAGATGTAGTTAATGATATTGACGGAGGTAACTTTAATTATGATTG
GTTCCCTATTGAGTTAATGCATCCATACGCATCAGGAGATACTGATGTAT
GTAGAAGAATTCATTGTGATGTAATTAAGAAACTTAAAGAACAAGATAGA
CCTAAGTCAATGCATTTATTAGAAGTTAATTACCCAAGACTTACTAAGTC
TTTAGCTAGAATTGAATCAAATGGTTTATATTGTGACTTAGATTATATGA
AAGAAAATGATGAGTCATACGAGTCTGAGATGGCTAAGAACCATGCTACA
ATGAGAGAGCACTGGGCTGTTAAAGAATTTGAAGAATACCAATACAATCT
TTACCAAATGGCGTTAGAAGAACATGAGAAAAAGCCAAAAGATAGAGATA
AAGATATCCATCAGTACAGAGATAAATTTAAAGATGGTAAATGGATGTTT
TCCCCAAGTTCCGGAGACCATAAAGGTAGAGTAATTTATGATATTCTAGG
AATTCAATTACCTTATGATAAAGAATATGTCAAGGAAAAACCATTTAATG
CTAATGTTAAAGAAGCAGACCTTACTTGGCAGGACTATAAAACAGACAAG
AAAGCTATTGGTTATGCGTTAGATAATTTAGAATTAAAAGATGATGTTAA
AGAGCTTCTTGAATTACTTAAATATCATGCTAGTATGCAGACAAAACGTA
ATTCATTTACTAAGAAATTACTTAATATGATTAATAAACAAAAACGAACA

-continued

TTACATGGTTCTTTTTCTGAGACAGGCACAGAGACATCAAGACTAAGTAG

TAGTAACCCTTAAATTGGGGTTGTAAAACTTTGTTAACTGCGGGAAGAGA

CTCGTTAGGTCTTAACTACTAACTTATAATGGAAACATATATAAGGGCAA

ACAGTAACGTGTTTGATATAGTAAAAAGGTTAAGAATAGAGAGAATCCGC

ATCCAAGACCCTGAAAGTATATAAAAGTATGGGTAAGGTTCAACGACTAG

GTGTTGAGACAATACAATCAATACACACCCACGAAAGCAAAGGTATTATT

TCTGTGGTAGGGAATAATAAGGAGAGTTATATGAAAGAGATTTGGAAGAA

AGTAGTAGGATTTGAAAACTACGAGGTAAGTAATAAAGGAAAAGTAAGGA

ATATAAAACTAACTATATTTTAAAGCCGTGGATAATAAATTCCGGATAT

GAGCAAGTATCTATAGGTATTGCTAATGTATTAGTACATAGATTAGTGGC

TATGACATTTATACCTACCGACAGCTATAGTATAGTTAACCATATTGATA

ATAATAAATTAAATAACTGTGTTGAAAATTTAGAATGGGTAAGTTACAAA

GGTAATAGTGCTCACGCTAATAAGCAAGGAAGATTGAATACTTATAGTGC

AAGAGAAAAACTTAGTTCTGTATCTAAGAAAGCCATTTATCAAAAGATA

TGGAAGGTAACATCATTAAGTTATGGGATTCACCAAGTGAAGCTGAAAAA

GAATCTAATGGGTACTTTAAAAGTACTAAGATTAGTTCCGTTGCTCACGG

TAAACGTAAGCATCATAGAAGTTATACTTGGGAATACGTATATAAGGATT

CAAAGAGAAGTTTAAATAAGTCTATTAATATGTATGATTTAAATAATAAT

TTATTATATGAAGATTTGACAATGAATAAAATTATGGGTATACTAGAAAT

GAATAATCATAAAACATTAAGAGATAAACTAAGAAATACAGATGACTTTG

TTGAATACAGAGGATATAAATTTAAAAATAATAATTAAAACCTACCACAG

AAATGATATATGATATAGTCTACTCAATAGTGAGAGCTATTGTGTTACCT

AAACAGTAACAGATTGTAAACTAAAAAGCTTACAAATTATAGAATTTACA

AAACTTACCTGCACACACATCAGATGTAAATAAGTTTGATTACAAACATC

CAATTAAACGTTCATTTGTTTCTAGATTTGAAAATGGAGTACTGCTAGGG

TCCGACTATAGCGCCCTAGAGATGCGTATTATCGGATTATTTACTAAAGA

CCCTGATATGCTACAATCATTCTTAAATGGGGAAGATATCCATAAGGCTA

CTGCAAGTATTGTTTACAATAAACCAGTAGAAGAAGTAACTAAAGAAGAA

CGACAAGCAACTAAAGCAGTTAACTTCGGATTAGCCTTTGGTGAATCACC

CTTCTCATTTGCAGGTAAAAATAATATGGAAGTAAGTGAAGCAGAAGAAA

TATTTGAAAAGTATTTCCAAACAAAACCAAGTGTAAAAACTTCTATTGAC

AATGTACATGAGTTTGTGCAACAATATGGTTATGTTGATACAATGCACGG

ACATAGAAGATTTATCCGTTCAGCCCAATCAACAGATAAAAAGATAAAAA

ATGAAGGTCTAAGACAGTCATTTAACACTATCATCCAAGGTTCAGGTAGT

TTCTTAACAAACATGTCTTTAACTTACTTAGATGATTTTATTCAATCTCG

TAATTTAAAATCAAAAGTTATTGCCACAGTACATGATAGTATCTTAATTG

ATTGTCCTCCTGAAGAAGCTAAAATTATGGCTAAAGTGACAATTCATATT

ATGGAAAACTTACCATTTGATTTCTTAAAAGCAGAAATTGATGGAAAAGA

AGTACAATATCCTATTGAAGCCGATATGGAAATTGGGTTAAACTATAATG

ATATGGTTGAATATGATGAGGAAGAAATAGATACATTTAATTCTTACCAA

GGTTATATTAAGTATATGATGAATTTACAGACCTTAGAAGATTATAAAGA

GTCAGGTAAACTAACAGATGAACAATTTGAAAAGGCTACTAATGTTGTTA

AAAGTGAAAAACATATTTATCAAGAAATTTAATAAAAGTATTGACAATAT

AGTTAACTTATGTTATACTATATAAGTAATAAATATAAGGAGGAAAAAGA

GTGAATACAGGGGAGATTAGATTTAATCGTTCTATGGATGAATGGATTAT

AACAAGCATGTACCAGGATGAGCTAGGTGGGATGAATATTGTTGTTACAT

TCTATAATAGAGAAGAAAATAAACATGGTTCTACAGTTTTACCAACAGAG

TCATCTACTGGAGAAGTAACAGAGGAATTGGCAAGTCTTGAAGAAGAATA

TCCTTTAGCTTTACCTTTAAGTAGTATCTCAGTTAATATTTAAAAGGAGG

AACTGATAAATGGAAATACACATTGATTCCCTAGATTTTACAAACTTTAC

TATTAAAGATAGAAATGGGAACTCACAAGAGTTTGATATTACAGATGAGT

TAAGAATTACAGAGTATACAATACAAGAGGATTTTATGCAACAATCAGCT

AAATATGCTTTTTGGGCTTCTATATTAGAGAAGGTAAGAGCATATTCTGA

AATGGAACAAAGAAACCTAGAAACAATTGGTAGTAAGCTAAACCTTACAA

TTAGACAAGAGTACGAACAACAAGGTAAAAAGCCTACTAAAGATATGATT

GAATCTAGTGTTTATATTCACGATTCTTATCAACAACAACTTAAAGTTGT

TGAGGCTTGGAATTATAAAGTTAAACAACTTCAATATGTTGTAAAAGCTT

TTGAGACAAGAAGAGATATGATGATTCAATTAGGTGCAGAATTACGACAA

ACAAATAAAAATGGTGGAATTACTAATCCATTTTCACATTAAAAAATAAA

GTAAAGAATATAATTGACAAATATAAAAAACTATGTTATAATAAATAAGT

AAATTAATTAAAAGGAGAAAAGATAATTATGGATTTCAATCAATTTATTA

ACAATGAGGCAAGCAAATTAGAAAGCAATAACAGTTCTTTTAACAATAAT

GTAGAGAGCTACAAACCTAAAAACCCTGTACTACGTTTAGGTAATATTAA

AGATGCAAACGGAAATAAGGTTGTTAAAGAAAATGCTTTTGTACGAGTAT

TACCTCCTGCACAAGGAACAAATGTTTTCTTTAAAGAATTTAGAAGAAGA

GGTATTAAGTATTCTAAGAAAGATGGTTCTCAGGGATTGACAGGGTTAAC

ATTACCTGCAGAAGAGGGTTCATCTGTCCTTGACCCATACATTCAGGATT

GGATAACAAATGGTGTTCAGTTCAGTAGATTCCCTAATAAACCAGGAGTA

CGCTATTACATTCATGTTATTGAATACTTTAATAACAATGGTCAAATTCA

ACCAAAAACGGATGCTCAAGGAAATGTAATGATTCAACCTATGGAATTAT

CTAATACAGGATATAAAGAATTATTAGCTAACTTAAAAGACACTATGTTA

AAACCATCACCTAATGCACCTCATAGCTTTATCTCAGCAACTGAAGCATT

CCTAGTTAATATTGTTAAAGCTAAGAAAGGTGAAATGTCATGGAAAGTAA

GTGTTTATCCTAATGCCCCTTTAGGTGCGTTACCTCAAGGTTGGGAACAA

CAATTATCTGACTTAGACCAATTAGGAAAAGCAACAGAAGAACAAAATCC

TAATTTTGTTAACTTCTTAATCAATAACGTTAATAAGACAGAGTTAAGTC

ATGATAACTTTAAATTTAACCGTGAAACAAATGTCTTAGGTGAAGAACCT

TCAGAGCCTAAACAAGCACCCACACAACAAGATGTAGATAGTCAAATGCC

AAGTAATATGGGAGGACAACCTAATCAGCCTCAGCAAGGTCAAGTAGGTC

AGTATGCACAACAAGGTCAAAGTAATGGTCAAGGACAGCAGTTACAAGGT

ACACAACAACCTATCAATAACACTCAATTTGGTCAAGGAACTCCTTCAGG

-continued

```
ACAACAACCAAGTAACACAGGTTCTGTTGATTGGGATAACTTAGCGCAAC
AACAATCACAACCTGATTCAAACCCATTCAATGATTTTGATGTTAGCAGT
GTTGATGATTCACAGGTACCTTTTGAGACACAACCTCAAAATACACAACA
AGCACCTGAACCACAAGAAACTACACAAGAGCCTCCAAAACAAAAGAAA
CGCAAAGTATTGACGATGTATTAGGTGGTCTAGACTTAGATAACCTATAA
GATATAGAGTGCCTTAGAGCACTCTTTTATTTGAGATATAATTACTAGGA
GGATATTAAATGGCAAGAGCAAAAAAAGGTAAAGAAGTCGATTTAACAGA
TTTAAATACAATTGATTTAGGTAAAGAATTAGGATTAACATTGCTATCAG
ATACAAACAGAGCAGATATTAAAAACGTTATACCTACAATGGTTCCTCAG
TATGACTATATTTTAGGTGGAGGTATTCCATTAGGTCGGTTAACAGAAGT
TTACGGTTTAACTGGCAGTGGTAAATCTACTTTTGCAGTTCACTTATCTC
GAATTGCAACACAATTAGGTGTTATCACTATTTGGATTGATATTGAAGGA
ACAGCAGATAACAATCGTATGGAGCAACTTGGTGTAGATGTTTCAAAACT
ATTCTCTATTCAATCAGGAGAAGGTAGACTTAAAAATACAGTAGAATTAT
CTGTAGAGCAAGTAGGTAAAGAATTAGAGTACTGGATTGACACTTTCAAT
GAAAAGATTCCGGGAGTACCTATTGTATTTATTTGGGACTCATTAGGGGC
TACAAGAACTCAGAAAGAGATTGATGGCGGTATTGATGAGAAGCAAATGG
GTCTTAAGGCATCAGCTACCCAAAAAGTAATTAATGCAGTAACACCTAAA
CTAAATGATACAAACACAGGGTTAATTGTTATTAACCAAGCCCGTGATGA
TATGAATGCAGGTATGTATGGTGACCCTATTAAATCTACAGGTGGTAGAG
CTTTTGAACATAGTGCTAGTTTACGTATTAAGGTTCATAAAGCATCTCAG
TTAAAACAGAAAGTGAGTTAACTGGTAAAGATGAATACCATGGTCACAT
TATGCGTATTGAAACTAAGAAATCTAAACTATCACGACCAGGGCAAAAAG
CTGAAGCAGACTTACTATCTGATTATATGGTAGGTAAAGAAGATGACCCT
ATCTTATTAAATGGTATCGACTTAGAACATACTGTATATAAAGAAGCAGT
TGAAAGAGGTTTAATTACCAAAGGAGCATGGAGAAACTATGTTACATTGA
ATGGTGAAGAAATTAAACTTAGAGATGCTGAATGGGTTCCTGTACTTAAA
GATAATAAAGAGTTATATCTAGAATTGTTTAGTAGAGTTTATGGAGAACA
CTTCCCTAATGGTTACTCACCATTACTTAATAACAAAGTAATCGTAACTC
AATTAGAAGAGTATCAAGCTCTTGAAAACTACTATAAAGAATGGGCTACA
GATAATAAACAAGAGGAACAAGAGGAAGAACTAAAAGGAGAATCTCAAGA
AAAGGATTCTGAATAATAGATGGATAATTTAATAGATAAAAACATGAATC
AGGTAAAAGAATCTTTGGGGAATGCAAATTCCTCAGATGTTCTTCCTTTA
CCTTATAAAGATATAGCAAAGAAATTTGAAGAAGTAAAAGAAAAAGGTGA
ATCAATTATCATTGAAGAAGGTGGATTCCCTTATACAGATTCTACAGTGA
TGTATATAGAACATGTAACAGATAGATGGGCAGGAGGATATTCCTTAATT
AGACATGAAGGTGAAGAAGTTAAAGTACCTAAGACTATCCATTTCTCTGA
TATATATGTTAAAGATAAATCACACAAAGTAAGAATAATCTTCGAGGGGG
CTAATCCTTATGAAGAAAGCTAATAATGGTAATAGATATGTAATAGATAT
AGATGGTATACCTGTTGATTTTGAAAGGGATTTAGATAGTTTACTTAATA
GGTATAAAAACCTTAGATGGTCGTTATATCATAGGTACGCAGGGATTTTA
TCTAATGATTTTGAAAGACAAGAACTAAGAGAATATATTGATGAGCAATT
TATTAAATTAGTTAAAGAATATAATATTAGAAGTAAAGTGGATTTTCCTG
GATATATTAAAGCTAAACTAACTTTAAGAGTTCAAAATAGTTATGTTAAG
AAGAATGAAAAATATAAACGTACTGAAATTATCGGTAAAAAAGATTATAC
AGTAGAGTCTTTAACAGAAGATTTAAATGAAGACTTCGAGGATAATCAAA
TTATGAGTTATGTATTTGATGATATAGAATTTACAGAGGTTCAAAGTGAG
TTACTTAAAGAATTACTTATTAACCCTGAAAGAGAAGATGATGCCTTTAT
CGTTTCTCAAGTAGCGGAAAAGTTTGATATGAAAAGAAAAGAAGTAGCAA
GTGAGTTGACAGAACTCAGAGACTATGTTAGATTTAAAATAAATGCATAC
CATGAGTACTATGCTAAGAAAGAATTAAATAACCATAGAGTTAATACTGA
AAATCATATTTGGGAAAACTAGTTACAGTGCCTTCCTTGTGTTATATTAT
TATCGAGAATTCAATAATAAAGCATAGGGAAGGCTTTTTTCTATGTCTTA
TAGAATGCTTTAAAATAGATTACTAAAATAAAGATTGGAGATTAAGCTTA
TGGCTAAAAAGAATGTTAATGATGTATTACAACAAGAATCTGTTACAGTA
GCAGATAAGTATTTACAAGTTAAAGTTAACCGTGACGGTTATACTCGTAC
ACATGAAGGACAATATGCGTACAAAGTAGTTTCAGAGGGAGAAGAATTAT
TCTTATACCCTGTACAAACAGATGGTAAAGGTACATTAAATGTAATGAAG
AAATCACCTATTGCTTACACTGATGGAGACAATATCCATTTCGTAGTAAA
CACAGTAGTAGACCCTTATAATCACTCATTTATCCGTACTGAAGATATTA
AAGGATTAGATAAAGGTAAACAACTTATTCAAGCTTTCTTAGCTTTCGTT
GAAGACCGTTTCAAATTTGGTGTTTATAACGTATTTGTTGCAAACAACAA
AGAGGATGTATTATCTATTGTAGACCCTACAGATAATGATGCAGATGAAG
TTAAAGATAGTTTAGAGCACGCACATGAAGATGTAATTGCGGATTTCCCT
GCTAGCCCTGCTCGTAAGGACGTTAAAGGCGTAGATTCAGGAGAAGGTCA
AGGAGACACTTCAGAACCATCAGCACCTAAGAACGTTCAAGTTACTCCTA
AGGAAGACGGAGCAGACGTATCAGCAGAATAATATATAGATAAGGATGGT
AAATTTGGCTAAGTTAAATTTATACAAAGGTAATGAGTTACTAAACAGCG
TAGAAAAAACAGAAGGAAAATCAACAATCACGATTGAGAATTTAGATGCT
AATACGGATTACCCTAAAGGTACTTTTAAAGTATCATTCTCAAATGATTC
AGGAGAGTCAGAGAAGGTCGATGTTCCTCAGTTTAAGACAAAAGCAATTA
AAGTTATTTCAGTTACCCTTGACGTTGATAGTTTAGACCTTACAGTTGGA
GATACTCACCAACTATCAACAACTATCACGCCTAGTGAAGCATCTAACAA
AAATGTGTCATTTGAATCAGACAAATCAGGTGTTGCTAGCGTAACATCAG
AAGGCTTAATTGAAGCAGTTAGTGCAGGAACAGCTAATGTTACTGTAACT
ACTGAAGATGGTAGTCACACTGATATTGTTGCTGTAACAGTTAAGGAACC
TATTCCTGAAGCACCTGCAGACGTAACAGTTGAACCTGGTGAAAATAGCG
CAGATATTACTGTATAGGAGGACAATAAAGAATGGAAAAGACATTAAAAG
TTTATAGTAATGGTGAAGTTGTGGGCTCTCAAGTAGCTAATAACGATGGA
GCTACTACAGTATCTATTACAGGCTTAGAAGCCGGAAAAACTTATGCTAA
AGGAGATTTTAAAGTAGCATTTGCTAATGATTCAGGTGAATCAGAAAAAG
```

-continued

```
TAGATGTTCCTGAATTTACAACTAAAACTCCTACTGAAGAACCTTCAGGA
GACGCATAATAATTAAGACCAACTAAAAAGTTGGTCTTTTTTTATTGACA
ATTTATAATATCTATGATACACTATATAAGAATTAAGAAAAGGAGGGGAA
AGTAATGGATATTCCAACAATATTATTTAGAAATCCATATGATTATACGA
AAGTAAAAAAATTAATGGAAAACAAAGAGCAGTATATTGTAGTAAAGTTT
GATTCTGTTTCTGTTCATAATTTAAATGTTCAAGGTATGATGAATGTCAT
CCAAGATTACCTACACATCTATGGTTACAGAGTTAAAGAGTACGGACAAG
AAAATTCTTCTAAAGATGATGAAAGAGACGTTAAAGGCTACTTATATGAA
AGAGTAGGTGAGTAGGGTATGGGAATTATAGTAAACTCCAACCATATTCA
ATCAGACACTTTATATGAGTATGATAGCTTTTTTGATATTGAGAAAGTAG
ATACATTTGAAGAAGGATTGCTTTCAATACAGGATGAGCCAACTGTTTTA
GCAGGATTCATCTATGATGATATCACATTTAATAAGGTCATTAATTCTAA
TTCAGATATTGATGATTATATTAAGAATAATGATATTTATTATGTCTCTG
ATATAGGATTACTTCCTGATACTTTTATCACTGTTGATTCTGATAGAAAA
TATTATTCATTATTACAACAGATAACTGAGTTAAGTAAAGACCCTTTTCC
TAAATGGGTAGAGGATGATGCAAAAGGTTTAACTAAGTATTATAACTTTC
AAGATTTTGAAGATGTATTTGATTTAAATAGTTTTTACAAAAAAGAAGTT
GACATGGTAAGAGAAAAGTGCTATAATAATGGTAATGTATATTTATTATA
TGAGGTTCTGCCTGATTATAAATTACCTCTAGCTTATAGTTTACTTTCAA
ACAAGGAGCATGGTATTGTTATTATCGGTTCACAGACACGTTCTAATAAT
GATATACTGACTTTTTATGTTAAAGGTATGGATGCTAAGCAATAGCTAG
TATGTTCAATGTAGAACATGATTATGATTCTAATATTTTCCATACATTTG
TAAACAGTCACATTAATATTTTAGGAAATCAAATAACTAAGTTTATAAGA
GAGAAAGGAAGCAGTTATGAGTAACTATAAAACAATAGAAGAAGTACAAG
CAGTTATTATTGGGGTATTATTTAAAGATGAAGGTAAAATTGTAACATCT
AAGTTTAATAAAATTACTAAAGAGTTTGGTTTAGATAGAATCGGTAAAGA
TGACCTTAAAGAAATTGTAGAGGATATATTAGACAAGACGCTTATCTAAATG
AACTTAAAAACAAAGCAATTAAAGGTAAAGTAACGTTAGGTGATTTAAAA
GATGTTGCAGATAACCAAGTATTCGAAGGTAATAACTACCATGAAGAAGT
ATCTACTTATGTAGTAGCTAAAGAAAAAGAATTGTCTCACTTAAGAGAAC
AGCGTAAGCACAATAGGCATACTGCATACCCTCAAATTATGTTTGATGAA
CTTAAAGAACATATGGTTAAGGAATTACAAGGGGAAACATTAGTAGAACA
TCACGGAAGTAAAGCTAATATTAATGATACAGAGCTAATTGTGTTACTAT
CAGATTTCCATATTGGAAGTATTGTATCTGATATGACTAATGGTAAATAT
GATTTTGAAGTTCTTAAATCAAGATTAAATCATTTTATTAATACAACAGT
TAAAGAAATTGAAGATAGGGAAATTTCTAATGTAACTGTTTACTTTGTTG
GGGACTTAGTAGAACATATTAATATGAGAGATGTTAACCAAGCATTTGAA
ACAGAGTTTACTTTAGCAGAACAAATCTCTAAAGGTACTCGATTACTTAT
TGATATCCTAAATGTACTATCTAATGTAGTTTCAGGAGAACTAAGATTTG
GTATTATTGGTGGTAACCATGACCGTATGCAAGGTAAGAAGAATCAGAAG
ATTTATAATGATAACATTGCTTATGTAGTGTTAGATTCTTTATTGTTATT
CCAAGAACAAGGGCTATTAAATGGTGTAGATATTATTGATAATCGTGAAG
ATATTTATACTATTAGAGATACCTTTGGCGGTAAATCTATTATCATTAAC
CACGGAGATGGGTTAAAAGGTAAAGGTAATCATATCAATAAATTTATCTT
AGATAGTCATATTGACTTATTAATTACAGGTCATGTACATCATTTCTCAG
TAAAACAAGAAGATTTTAATAGAATGCACATCGTAGCTTCATCTCCGATG
GGATATAATAACTATGCTAAAGAGTTACATTTATCAAAAACTAAACCTTC
ACAGCAGTTATTATTTGTAAATAAGGAAAATAAAGATATTGATATTAAAA
CAGTATTTTAGATTAAGGATGGTTAATAAATGGATACAATTTTTATTAT
AGGTGTAGCGTTTATAACTTTTGCAACATTTAACATAGTCTTTAGATTAT
TTGATTTATGGACTACAGAGAAAAAAATGGTAAGTCAAGGACAACCTCCA
CTAAGTAACTTTGAGTACTATCATGTGATAGTACCTTACTTAGTAGGTGT
TATTGTTATTATACTGAGTATTATTTTTAGGGATTCCTTGTATTCCGCAC
AATCAGGGTTCGGTGTTATTATTACAAGCTTTATTTACATGCTAGTTTAT
GTTATAATTGGTCTTGTAGGGTCATTTGTACTTACAATATTCCAAGCTAG
AAAAGCTAGACAGTATCAAACACAGGAGGATAATAATGAAGTTCAATGAT
ATTTATGAGCAATTAATTAAAAATGATCACAGTACAAAACATTCATGAGTC
TCAAGATGACAAAGGAAATATTTATACAATACAGTTTGATAAAGGTAATG
ATAAGTATTTATTTAATGTTATTAATGATGGATTCTTGAAAGAAATGACA
AATGGTATGGTAGACCATCCTGAAGGTCAGCCATATTCAGTAAGTTTAAT
CAATAAAGAAACACCTAGTATGTCAGTGAAACAATATTTAACAGATGTAG
AAGATATTGTACCTACTATTAGAAAAATGGAAAAGGATTTCTTATAGAGT
CAAGTCTTTACTTGACTCTTTTTACTATATATGGTATATTAATATAGAGG
TGACTTAAAAATGGATTTTAATTTTAGTGCTTTTGATAATAGCTCATTAG
CAATGAGAATTAGTGAGGGTGTATACTATTTCAATGATACGCCTTATTAC
TTTATTGAGCATGTAGAAGAAGAAATCTCTGAGTATGTTATTGTATATGA
CATACATGACAGAGAGGAAAAAGAAAATCCTCAGAAGAAATATAGAATAG
AACCTTACCAACGTACAATACCGGGAGGAACACCTCTTAGTAATTTAATT
AAGAGTATGATGCCTCAACGTAAGTATCCTAAGAAGGTTACAGAAGACCC
TATATTTGTAGCTAATGTTATTCCTTTAGGAACAGATACAGTAACAGGTA
AAACCGGTAAAGGATTTTTTGAAAGAGATAAGGATAGAACTATCTATTCT
CAAAAGGAACCAACTAAAGTCGTTCATGGTCAATACACAGGTGTTTTTAT
AGGTCTAACAAGTGTTAAGTGGAATAGAACATATACCCCCTTAGAAAGTG
TTGTTGAGTACTACAAAAGGGTTAAAGGAGATAGGTTAAATGTCTAATGA
TGTAGTTAAGTTCTATGAAAAAGATATTAAAGACCTTATCAGAACTAAAA
AACACATGTTCAAAGACGATGAAATAACTAGTGATATAAACGATATACGA
ATCTTCAATGAGAAAGTCATTTGTCAAGGTAAATGTAGAACAGATTGTTT
AGTGTTAGACCGTAATGGTACAGTAATGGGTATAGAGATAAAAACAGAAC
GAGACTCTACACAAAGATTAAATAACCAATTAAAATATTATAGTCTAGTA
TGTAAGTATGTATATGTAATGTGCCATGACAAACATGTACCTAAAGTAGA
ACAAATACTTAAAAGGTACAAACATAATCATGTAGGTATAATGAGTTACA
```

-continued

```
TTAGTTTTAAAGGCAAACCTGTTGTAGGTAAATACAAAGATGCTACACCA
TCACCACATAGAAGCCCTTATCATACAATGAATATATTATGGAAGACAAA
CTTAATGACAATACTTAGATTGATTAGAGACCCTCATACGTATAGAACAG
GGTATAGCTATAATGCTAGTGGTAGATATAGTGGAGGGGAAGGTAATTTC
TCCCAAACAACTCAAAGTAAAAGAATGAAAAAACCTGCTATTATTAACCA
AATAATTCATTATGTAGGGGTAGATAATACTTATAAACTCTTTACAAGAG
GTGTTATCTATGGTTATAATAATAGGTGGGAAGTTATAGAAGAAGATTTC
TTTAATACTATGAAGAATGGGGTAAGAGTAATTAATGAGCAAAGACAAAC
CAAATAGACGTAAAGAGATACAGCATCAACCTGTTAACTTTGCCCCTACG
AATACTTTAACAGGAGCTAATAATAGTTTCTTTGCTAAAAAGCCTTCAGA
GCCTAAAGATGCAACATCTGTTATTGAATATCGTATACTATTTATTAAAA
GATTTGATAACGTAACAAGTACAGATGTGAAATTACAGAAAAAGTATGCA
CTAAATCTTATTAGTGAAGCACTTGATGTTAAAGAAACTTACTTGTCTCT
TAAGCAAAAAGGAAAAAAAACAGAATCTATTTTGCATACAGATAGAGTTT
ATTATGTTCATAGAGGTAAAAAACTTATTGGAAAGTGTAGTATCAGAGAA
CAAAGAACATTTAAGGGTAAACATTTGATATTTATATTCAAAACAAGACA
TAGAGTTAAAGCAGAAAGGAAAGATAAATAATGTTAAAAGGATTTTCAGA
ACATGTAGACAAACCTACAACTATTAAGACCTTATACAAGACCTTAACAA
GTGGTAAAGTAGAATTACTAGGTGTATCTTACGATAGTGATTACTTCCCT
TCAGGTGTTACAGTACAATCTTACATTGAGGATATAGGTAATGAAGATGA
GGGTCTACAGTTTGTTAATAAGGTAAATGTAGTAGAATCAATGAAACAGG
CTGTAGTAGGTATGAATAATCAATTAGGTTCTTCAGGTCTTGGCTATGTG
AGAACTGAACAACTTAAAAAAGAGTTGGAAGAGACTGGACTAATGACAGA
TTTACTTGCTAGAGGTACTAACTTAACCTCTACTAAGAAAGTAGATATTG
TAAGTACTTTTATTGAGCCTGAGGTAACATACCAAAATATTACTATAGCT
AAAGATATTAAACTACGTTTGTATAAAGTAGAAGAAGAATCACCATTAAA
TGGTTACACTCATATTGTATACTTACTTACTACAGAAAAACTATATGATG
GTCAAACACTCTTCGGTATGCTCTCTAAAAAAGATAAGTTATCTAAAGGA
GATACTGATAAATTATTAGCATTCTTCAGAAACAATAGTTTAATAAGTAA
AAGTGTATTTTGTGTTAAGTTATTAAGTAAAGACTACTACTTTAATTTAT
ATAATACACATGAGACAGGGATATTCTTTTTAGAAGACACAGATGTTATT
ACTATTGCTTGTGGTCAGTCATATGTTAAAGTTAACACTAAAGATATTAA
GTCTAGTTATGTTAAAATTGAAGATAAGACTCATAAATTAACTGAGCTAG
TAATTAACCTAAAGGGTGACGACACATTAACTATTTTATTCTAGGAAAAT
GTTATAAATATGTGATAATTAAGTATAAATATACGTTATATAAGAAGTTT
TCATAATGTTTTTAATACAGAAACTAGTTAAGTTTTTTCTACTTGCTCTA
GTTTCTGTGAAATTATATTTATGAAAAGTTAAAATATCTTTTAGGTAAAG
GCTTTGTAAATAGTTAAAAAATATATTAAAATTTTATACAAAGTAGTTAA
TAAAATTATATTACATTTATATATTATGAAATAATAACAGAAATTGTGAT
ATATTATATAGTGTAACCTTGAAACAGTTGATGTTGTAGGGTTTGTTTAT
GTTCGTTAAACTGGTTTCAGAACATCAGTTACCATAAATAAATGACAGTT
```

-continued

```
AAGGAGAGCTATATAATGGCTAGAAAAAAGAATTTAAGAAATAAAAACAG
TGATATAAAAGTTGTTCCTGATAAAGAAAAAGAAAGTATATTATCTAAGT
TATACCATAATAAGTTACTACGTTCAAAGGTAGATAATGCATTAGATGAA
GATATGAGTTATGATGATATTATAGAATTATGTAAAGAATATGATTTAGA
ATTGTCTAAATCAGCTATTACAAGATATAAAAGTAAAAGAAAAGAAGCTA
TTGAAAATGGTTGGGATTTAGGAGAATTAATTGATAAACGTAAAAAAACA
AGTGTAAAAGATATTAAGGAAAAAGAAACTCCTATATTAGAAGAGGAGCA
ACTTTCTCCATTCGAACAATCAAAACATCACACACAAACAATTTATGATG
ATATTCAAGTACTAGATATGATTATTTCTAAAGGTGCAAAAGGATTAGAG
TTTGTGGAAACTTTAGACCCTGCTTTAATGATACGTGCAATGGAAACTAA
AGATAAGATTACCGGAAATCAATTAAAAGGTATGTCATTTATTGGACTTA
GAGAATTACAATTAAAACAAACAGCTCAAGATACAGCTATGAGTGAAGTA
TTATTAGAATTTATACCTGAAGAGAAACATGAAGAGGTATTACAACGATT
AGAAGAACTACAAAATGAATTCTACAAAAATCTAGATTTAGATGAGGAAA
GTAGAAAATTAAAAGAAGCTCTTGATAGAGTAGGCTATACAATTTAGATA
GTGAGGTTAGAGTAATGGCAGATGAGATTAGTTTAAATCCAATACAAGAT
GCTAAGCCAATTGACGATATAGTAGATATCATGACATACTTAAAAAACGG
GAAAGTACTGAGAGTTAAACAAGACAACCAAGGAGATATCCTTGTTAGAA
TGAGTCCAGGGAAACACAAATTTACTGAAGTATCTAGAGACTTAGATAAA
GAATCATTCTACTATAAAAGGCATTGGGTTCTCTATAATGTATCTGTTAA
CTCTCTTATAACATTTGATGTTTATCTAGATGAAGAATATTCAGAAACAA
CTAAGGTTAAGTATCCTAAAGATACTATTGTAGAATATACAAGAGAAGAC
CAAGAAAAGATGTTGCTATGATTAAAGAAATACTTACAGATAATAATGG
TAATTATTTCTATGCACTTATAGGGGAAACAATGCTCTTTGATGAAAATA
AATTAAATAAAGTTAAAGATTAGGGTTGACAGCTCCTATAGTTTATGATA
TAGTATATGTATACTAAAAGTAAAGGAGCTAACAATTATGTTTATTTCAT
TAAATCAAGAAGAGAAAGAATTATTAACTAAAGAGGAAAGTAAATACACA
CCATTAGAAACATCAAGAGAGTTTAACACACCTAAAGAAGAATTCATTGT
AACAAGCTATAATGAAGGTAAACCTTTAGATTACATTGCAAAAGAAGCTA
AGGTAAGTATGGGATTAATTTACACAGTTCTAAACTACTATAAAGTAGGT
AAGCGTAATAAGAAATCACCTGTAGAAGAAGAATTGCACATATCTTAAA
AGATAAAAACTTAGTCAAAGAGATTATTAAGGATTACCAATATATGAATT
TACAGGACATTTATAGTAAATATAATCTTCATAAGAATGGTTTATATTAC
ATCTTAGATTTATACCATGTGGAGAGAAAATCTGAACTTAAGGACAAAGC
ATTAGAAGAGGATAATATTGTCGTTGAGTAAGTAAAGAGGTTATAATATG
AGAAATAAAAAATCATTTCAAGAGCAGTTAAATGACATGCGTAATAAAGA
GAAATGGGTATCTGAAGAGGAGTTCACTGAAGAAGTGGCTCCTCCTGAAG
AACCTGAAGTAGAAGAAGAAAACTATATACTTTAAATGAGTTAAAAGAG
AGCTTACTAGATGCTCAAGGATTAAAAGATGTTGTAGCTGATTTTCCTGC
ATCTAAAGATTTATATGAACCTAATAAGTTATATATCTGTACAATACCTA
```

```
AAGGATATCAGTCTACCGAAGTACAACCAGGACAATATATTGGTATTAGT
ACTGGATTATTATCAGAGTCAGAAGACTTCAGCCATTTAAGAGGTCAAAT
GCCTAGAAACTTATATGAAACTTCTCATGTTTTAAAACCTTTGATACGTA
TTAATAATACAAATATTGAATACCAACAACATGAGTTACTTGAAGACATT
AAGGATGACAAAAGATATATGATGTAGAGTTAGAAGACTTAAGATTAGC
AACAGGAGAAGAAGTTTCTCATTTAGAAATTGTTGATAATAAGTTTTTTG
AAAGTCGTATTAATGAAGTTCTTGACCGATACACTGAACTAACGGATTCC
AATGATTTACTTAAGTACTATAGTAAATTACGAGAATTAGTAGGTAGTGA
CAAAATGATTTATTGTTCACTCCTCGATAAATGTGTTAAAATTATAGATT
AATAGTAGTCTCCTCTTATATTATAATTGTAAGAGGGGACATTTTTGTAT
AGAGGTGTTAATTATGTCAAGAAAAGCAAGTATATTCTATATACTAGTGG
TTATTGTTTTGGCTTTCTCTATCTCATCTTATTATATATCTTCTTTCATG
TATCACGACAAAGCAAAAATGAAGTCTCTACTGAGTTATCGAACACAGG
AAAGATTAAAGAAGAAAAGAACGTAGAATTTGTCGGTGACTACACATTGA
AAAAAGTGGAAGATAATAAAGCTTATTTTATGGAAACATTACCTACTTAC
CTACCAGGTAGAACAGGAGATAACAGCATAGATATGAGGTACTACAAAAC
AAGTAGATTTAAGGAAGGGGTAAATTTCAAGCTTATTAGGGTATATACTG
AAGATGGAGAAGATAATCCAATTCATAAGTATAGGTTTGAAGCAGTACCA
ACCAAAAAGTAATAAGGAGGTGACTTAAATGACAACATTAATTGTCGTCA
TCTTTATTGCTATCATTTATTACTTATGGAACAGTGATTGAGTCAAGTTA
ATTCTTGACTCTCTTTTTGTTTATGGTATATTAATATATAGAAAGGAGA
GATTAACTATGGAAATGGCAGATTTAGAAAGATTTGATGCATTTGTAAGA
CTAATTTCAGATGATGAGCTTTCGGAGGAAAGAATACTGGAGTTAAGCGT
AGACTTACTAAACCCGATACTAGAAGGAGGTACAGCTTACAAGGCTAAAA
AACGTATTAAGAGTAAATTTGGTAAGTTAGAAGCAAAAAATTTTAAACGA
AACTATAAATTCTTACTTAAGTCGATAGCTCAAATAGACCAAAGGAGATA
GGACAATGACAGAAAGGGAAAAATTAATTAAAGATATTGAAGAGGCTAAT
AGAGACATACAGTTACAGTTAAAAGAAGTAGATAATTATAAGGACAGCAT
ACGTTCTAAAGGAACAAGAAATTATATTTCTACAAAGGTATTAGATTCTA
TTATGGTTGGTTTCATAGTTAGTTTTTTAATACTCATTATAATGCGTGTA
CTTGAATATTTTGTAACAGGTAATGCTGTTTACTCACCTTTAGCGCCTGC
AGTTATTATTATGTTTGTTTTAGCACTAGGTACATGGAAAGTAAGTAAGA
TGAACAAAATAGTATCTTATAGAGGAACTATTAAGATGTACTGGGAACTA
AGTAATGCTGAGCAAAAACAAGCTAAGGTATTTAAGTATCCTAATGATGA
AGTAGATATTGACCAGTTATATAGTGCTGATAAAGTATCTGTTGATGCAC
TTTTAGTGGGTATCATTAAAAATTAAATAAATTTATAAATACCTGTTGAC
AGCCTGTTGACAGCAGGTATTTTTATAGTATACTTTAGATATAAAGAAA
AAGGAGGTAATATAATGATACCCGTAATAGTTATACTTATTGGACTCATA
TTATTTTTATCTAGCGGTTATAAGTTGGTATTGGGTAAGTATTATGATGA
TGTAGATTTAAAAATACTATTTACCATATTTGGTGTTGGGATTGCATTAC
TACTTGGAGGATTTATATTATAAAGCAGGAGCTATTTTATTTTAAGGAGA
```
```
GGTAAATATGAATTATAGAGATTTTATTACAGATTGTATTAGCGGTGGTT
ACAACGTACACATCAGTGTTACAGAAAAACGAGTACACATTATTTCTGAG
ATGACATCAGCATCTTACCCTAAAAAGGAAATTAACTTAGATGAACTACA
AGCTTATGTGTACTATATGAATAATTTTGGAAGTCAAATTACAACGGAGG
GGTTATAAATGGAATTGGTTATTAATATTGTAGCAGTATTGGTTGGTATG
TATGCTATTTATTTCTATGTTACAAAGTTTAGTACTGGCTTATCAGGTAT
TTTAATTGTTTTAGGGATGGCTATTGGTCTTTACTTCTACTTAGACTATT
TAAATGTCAGAGAAATGTTATTCGATTAGTTTCAGTAATGTTCGGAGCT
TTCTTATTTAGTATTGAAATGATTTATAATAAAATTATGTTCGAAATTAA
AAAAAGCAATGTTCAGAAGACTGTTAGAGTGTATGATAAAGAGCAGTAAT
GATTTTACCATAAGAGTACCTAAATTACTTTAAGTGCTCTCTATGGTACC
TTAAAGTAGCTTAGAATTGAAATTAAGGAGATGAACAATTATGTATCCTG
AAATAGATGTGGAAGAATTAGCGTATAAGCTAAAAAGTACAAGAGAGTAT
TTAGAGAGCATTACAACAAAAGAAGTAGAAATTTATGAAATCTATCATCT
TAAAACAGGTAAGTTAGTTTTTAAAGGTGAATACATTGAGGTAAAAGAAT
TACTGAGGAAAATGTATAAAGAAAATTTAACACTTGTAGATGTAGATACA
ATGTTAAGCATTGGTAAAGGATTTATTGATGTAATTAAGAATATATCGGC
AGAAAATGTATTCCAAATAACATATAAAAAGGAGCTATCAACAAAATGAT
TAAAATATTTTCAGAAGTAGATAAAGAATACAAACCTATTATTACTGAAA
AGTTTCCTAATGGTGAGATTAATTTTAAATATGATGATTTAAAGTATTTA
GTAGAAGAGGACTTAAGATTTGATGTTTTCTTTAAATGGGAAAATGACGC
AGACTTAATGCATTTGTATATGTTTACTAAGTATTTAGAGCAACTAGGTA
TTAAAGATAAAGCTGAATTTTAGAGATTGCATATCTACCTTATAGCAGA
ATGGATAGAGTAGAAGAAGGACATAATAATATGTTCAGTCTTAAATACAT
TACAGAATTTATTAATAACCTTAATTATAAATCGGTATGGGTAGCAGAAC
CTCATAGCCCTGTAACAGAAGAATTACTTACTAATTCTTTTGCTATTGAT
GTTACACTTAAATTATTAAATCAGTATATTGAAATGTCCGAAGAGCCTGT
AACAATAGTACTACCTGATAAAGGGGCATACGATAGATATCTATTTGATG
TAGAACGTATCTTAATGGAATCTAATATTGAATCATATTCAATTGTATAT
GGTGAGAAGAAACGAGATTTTGAAACAGGTAAGATTAAAGGTATTAAAAT
AATTAAAGATAAAATACTTTATATGATAATTGTATTATACTAGATGACT
TAAGAAGTTACGGTGGGACATTTGTCGGTTGTAAAAAAGCCCTTGACAAA
CTTAAGGTAAGTAGTGTATCATTAATATTGACTCATGCAGAACGAGCTTT
TGCAGAAGGAGCATTACTTAGCTCAGGATTTAAAGATATTATTGTAACAG
ACTCTATGTTCCCTAAAAATAATTGGGAAAAAGCTATTGCTAAACATAGA
GCTAGAATCAACGGAACTGAATTACAAATAAAAGATATCGAAAGATATTT
ATAAAAGGAGAAAAATAAATTATGCTAAATCCAACTTTAATGTGTGACTT
CTATAAACTAAGTCACAGAGAACAATACCCTGAAGGTACAGAAATTGTAT
ATAGTACACTAGTACCTAGAAGTAATAAAATATTATGAACACAGTGATAAT
ATTGTAGTATTTGGTATTCAATCACTTGTTAAAAAATATTTTATTGATAT
```

-continued

GTTTAATAAAGAGTTCTTTAACAGACCTAAAGAGGAAGTTATTAATGAAT
ACAAACGTACAGTTAAATTTACACTAGGACAAGAAAATCCTGATGCTAAA
CACTTAGAACAATTACATGACTTAGGTTATTTACCTATTGATGTAAGAGC
TTTAAAAGAAGGTACTGTTGTTCATCCTAACACACCTGTTATGACAATTG
AAAATACTCACTCAGATTTCTTTTGGTTAACTAATTACCTAGAAACTATT
ATTAGTACTCAAACATGGCAAGCAATGACTAGTGCTACACTAGCATATGA
TATGCGTAAAATGCTAGATAAATATGCAATGGAAACAGTAGGTAATATTG
AAGCAGTAGATTTCCAGGGTCATGACTTTAGTATGCGTGGTATGAGTTCT
TTAGAAACAGCTCAATTAAGTTCAGCAGGTCATGCAATTAGTTTTAAAGG
TAGTGATACAGTACCTGTAGTGGATTTCTTAGAATCATATTACAATGCAG
ACGTAGAGAAGGAAATGGTTGTTGCTTCTATCCCTGCTACTGAGCACTCA
GTAATGTGTGCAAATGGTAATTATGAAACCATGGATGAGTATGAAACATA
TAAACGTATGTTAACAGAAATATATCCAACAGGCATTTTCTCTATTGTGT
CTGATACTTGGGACTTTTGGGGTAATATGACTAAAACTTTACCTAGATTA
AAGGATATTATTATGGAACGTAATGGTAAAGTAGTAATCAGACCTGATAG
TGGAGACCCTGTTAAAATTATTTGCGGAGACCCTGATGCAGACACTGAAT
ATGAACGTAAAGGTGCAGTAGAAGTGCTTTGGGATACATTTGGAGGTACT
GAAACTGAAAAAGGGTACAAAGTATTAGATGAACATGTAGGATTAATTTA
TGGAGACTCTATTAACTATGAACGTGCTCAACAAATTTGTGAAGGATTAA
AAGAAAAAGGTTTTGCAAGTATTAATGTTGTATTAGGTGTAGGTAGTTTC
TCTTACCAATTTAATACTCGTGATACCCACGGGTTTGCAATCAAAGCAAC
GTATGCTAAGATTAAAAATGAAGAAAAACTTATCTATAAAAATCCTAAAA
CAGATAGTGGTAAACGTTCACATAAAGGTCGAGTAGCTGTATATAAAGAC
GGTTCATGGGAAGATAACTTAACCTTACATCAATGGCTAAACAAACAAAA
TGTTAATCAATTAGAAAGTATTTGAAGATGGTAAACTTTATAGAGACC
AGTCGTTAAGTGAAATTAGAGAAATAATTAAAAATAATTAATAAATATTT
AAACTCCCTATTGACAAAGGGAGTTTTTTATTATATAGTAGGGCTATAGT
AAATAAAGGAGTGAAAGAAATGATTTATAAAATATCAAAACATAATTACT
ATAGTAGGTTTGAATATTCATCTTATTTACCTGATGAAGGATTTGCATAT
ATAGATTATGTAGATGTCATTCTTATAGGTGTAGATAATCCAAAGAAGAG
AAAAGTTATTACTTTAAAAGCAGATGAGTTTAATCCTAGTGATTTTAAGG
TTGGTCATAAATATAATATTATAAAAATACTATGGTTTGAGAAATGGGAA
TGGTTACAGCCATAGGGAGGAGAGGTATACAATGATTATAGATAAATTAA
ATGGAGTTAAATTAGAGATTGGCGGTCATGTTGTATCATTTAGTGTAAGT
AAGTTTAAAACGATTAATGGTGAAAGACAATTACTTGATTACCACCATAT
CAAAAGAGGTAAACAGAGATATTTTAGAACTACTGAGGAATTCTATAATG
AGTACAAAGAAATAAAACCGGATAAGAATGAGATAGATGAAATGTTTGAA
TCTTTAGGTTACGTAAATACTGAATTAGAAGATGTAGTAAGAAACCAAGA
GAAAGTGACAGAGATATTAGGAGTTAGTGAACAGTATTTAAACCAATTGT
CTTATAAGGCTATAGAGGAATATGTAGAAAAAATAGTTATCTTAGAAATT
AAAGAATTAAAAGGAGAGATACAATGATAAACATTAATGTAACTGAAAAA

-continued

GAAAAATTAGTTGTAGGTGATTTAGTAAAATCAAGAGAAGATGGTACATG
GGGTATTGTAGTAGAAGATAAGCAAGACTTAAATGTAGTTGTGTTAAATG
ACGAGCCCTGGTTATTTTATAAATCAGGAATTAAAAGAGTAGAAGGGCAA
TTAGAAGAGGACTTTAAATTTATTAAAAACAGAGAAGAGTATGATATAGA
TGTAGTTAATTCTTCTTATAAATAAATTCACATCTACCTATTGACTTAGG
TAGATACTTATTATATAATAGTATACAAGGAGATGAAGTATGATGAATGG
AAAACAAATTTATGTATTTTTAAGTGACCAATACAGTAAAGATATACTCA
GTTTACAATTAGGTCTTATTAAGGAATGGTCTAGGAGAGAACTAACTTAT
TCAGATGATGTCGGTTCAGATGCAGATGTTGTTATTTGTACTGATATAGT
AAGAGATGATTTCGTAAAAAAACTAAGTAAAAATAATAGCAATGCATTAT
TTGTATTTATTAGTTCTAGTTATTGGATAGGTTATAAAGGCGGAGAATTC
TTTGTTGCAGTTCAAGACTATGTGAAAGGTATGTAAGATATGAAAAAATT
ATTAATATTATTTACATTAGCTAGCACTTTACTATTAGCAGGATGTACAC
CGGATAATCATGAAGGAAAAGTTTTAGGAACAGGAGAATATAGAGAGCCA
ACTACTTATATCAAGTCAGGAAGTGTTACTGTACCAGTTATTGGTGAAAT
GAAATACTATGTAGACTTAGAAACAGATAAAGGTGAAGACCGTGTTTATC
TTAATAGGGAAGTTTATCGTAAATTTGATAAAGGTGATGATTTCTCTAAT
GTAGGTAAAAAAGTATATAAAAATGATGAATTAATATATAAAGGGGACTA
ATTAGTATGAAACAATTTATCATGATAAAAAAGATAGTTATAATAGTAC
AAATCGTAATTTTGATATTCAATATTATAAAGGTATACCTTTACAACAAA
TTGATAGGGGTATGGTCAAGCAAGAGCTAGGAGATTTACAATAAATAAT
ACGAACCAAAATATATGGATACCTATGACATATTTAAAACCTAATGGTAC
TCTTAAAAATAACATTGATATAGATTGGATACTTGTTAAAGAAAAATGTA
GTTTAAAGAAAGCAGGATTAGTAATAAAAATAGAAATTACAGGAGATGTA
TTATAATGTATATATTAGAAAGAACAATTAGAGGTTTTGCAGGTCAAACA
GAAGATATTTTACCTTAAAGGAGATGAATTAATAATGGAGTATGAAAAAA
TGATTAGAGAAATAATGGTAAACTCTAAAGAAATGTCACTAGAAGATAAA
AAACATTTAATGAGTTTATTGATGAGTGCTTATGGTGACTTATCAATACT
AGTAGCTTTTGAAGAAGAAACACAGCACATATGTATGAAGAAATAAAAC
AGTATGATACTAAAAAGTTACTGAAACCAAGTATGGTAAGTAAAGATAAT
TATATGAAATAATATGTAACCAATCAGGAGGAATAACTAATGATAAATAT
AGAACATGATTATACAATAAGAACTGTAGATAATAGAAAGTATACTTACT
ATAGTAAACATGAATCCCCAGTTACTTTATATAAAAATATTATAAGTAAA
GATTGTATTGAAGTAACTAAATATGGGAAAGATAAAAAAGTTATTATAGC
TACTAAATATATTGTATCTATTGAACGATGGTAATTACAAGGAGGAGTAG
TTATGAATGCTAGGGAAGCACGTAAAAACACTAAAAACTATAAGGACTCT
AATGTAGTAACTAAAGAGCAACACTTAACTTATATCTATAATAAGATAAA
CTACTTGATTGCAAATAGTAGTAGTCAGGGTAAGACATATGTGGCAATGA
ATCTAAGAACAGATTATCCTGATGAGTTTTCTTTATCTAAATTAAAATAT
CTAAAAGAAATTAAACAGCACTATAAAGACCTAGGATTTAATGTGAAAAC

-continued

```
GCAAGTAAGAAAGGCAAAGTGGTCAGAGAAAAGTGTAATCAGGTACTACT
TTAACTTAGGCTATATAGACAGCGTGTTAGTACCTATTATACACATTAGT
TGGTAATTACAAGGAGGAATAGTTATGTTTTTAAAAAGAAGAAGTTAAG
CAATGTAGAGAAACAAATAAGACAAAACCGTAATAAAGAAGACAAAGAAA
GAAAAGAACATCAAGATAAGTTAAATACAGATATGTATAAAACGTATGAA
TTAGATAAAATTGTAGAAGAACATTTAAGAAAATTAGACAATATATCCCT
TGAAGGATTAGAACTAACTTCAGTGTGTTTAGGGACAAGACTTGTTTATT
ATTATTCAATAGGCAAGGATTGGGATAAACAAGTATATAGTTTAAACGAA
TTAGAATATATGAAGAAGAAATTTAAGAAACTAGGATTTGAAACTCAGAT
AACAAACGAAGATATAGGATTTCAACCTTATATTTATTTAAGATTATTAT
GGGATGCATAAGTAATTATTATTAGAGGAGGAATAGTTGGTGTTGCACAG
TTAATTACGGATTATCATGACGGACATTAAGTATTGAATATTGTTGACTA
ATAATAAGAAGAAAATATTATTACTACTAAGTACCTTTGTTATGTACTAC
TATTACTACTACTAAGTACCTTTGTTATGTACTACTATTACTACTACTAA
GTACCTGGGAATTCTTTTACCTCTCTCACTCAGCCTATTACTTATTACCG
ACTTCCCTAACTACTTATTCTATAGTTATAATATTCATTTATTATACAAT
ACTTAAACTATAGTATTCTACTGTTAATCTATGCTGAAGCGGTCTTAATC
TATGGTTATTATATAATAATCTTATATAATGGTACATTAATCTAGTATAT
TACATTAGAATCATTCTAATCTAGGATTTTAATCTTTAGACCCTAGGAAA
AGTGGTACTAAAATATAAAACCCTATAGGTATGGGATTCTTATTTTTAAA
ATTACTAAAAGTATTAGGTTTTCCCTAGGGCAAAGTTTTAATGTACTTA
AAATAGTAAGTAGCTACTTATCATTTAGGGTTCTATAATTGAGAATATTG
AGAGATAATCCGCTTCAATTGTAATTAATTGTTGACAACTATGAAGCGGG
TATGCTATAATTAGGTATAGTCAAATTTAGGAGATGAAATAGATGATTGA
TATATACTTAGGAGAAGGTTATAATAAAGAATACTTGTCTAAAGCACTCA
GATTAATCAATGACCATGCTCCTAGGGAGTTAAGTTATGATTTTAATAAT
GTAGAAGCGGATGTTAATATTCACACAATGTTATATGTTAAACCTGAAGA
TAGATTTATATATAAGGATATATCCTATGACTTCCCGGGTGATTTAATTA
TTTGTATAGTTGATGATGATGCTATTGTATACCACCAAGGTGAGCAGATT
TCAGGTATTAGTATTTTAAGAATACTAGAAGAGATATTTTAAGGAGGATA
AGTAATCATGATAGGAATAACAATATTAATTACGATAATGAGTATATCAA
CTATCTCTATGTATATTTATTTTTAGTAGACTTGATTCAGTCAATCAGA
TATAATAGTTTTGATAAGGTAATTAACGTCATAACATTTGTACTTATGAC
AGTTATAATAGCATCAGGTATTTTAGCTATACTTGGAATATAGAGCTCAT
TTAAGAAGCGGTTAAGTAGTTAGAGGGGATTTGTCCTAAAATAGTATACC
GCTTCTATATGGAAGGCTGAGAGGTCTTAGAATTGAAAGGAGAGATATAA
TGATTCATATATTTTTAACTGATAGTTATGATAATAAAGTTTTAAATACT
GTACTCAGATATATTAATACTACTAGTGATAGAGAGCTTAGTTACTTAAT
GGGTAAAGGTGAAGCGGATGTATGTATAGAAAAGGGAGTATTTAGTAATA
TAGAAGATGTTAAAATTGACTCTGAGTTTATTGATAGAGGTAACTTATGT
ATACTTATAAATGAAGATGGATTAGTATGTAGTTACTACAGAGGAGAATC
ATGTAATGTTGGTTCCTTTGTAAAGGAGAGGTTATAATGATAGAAATTAG
GTTAACTGAAGATTATAATGACTTGAGTCTTAAGGCATTACTAAAACGTA
TTAAAGGGTAGCTCCTAGGGAATTAACTTATGGTTTAGAAGCGGATATG
GATACTACAGATGTTAATATTGGAGATTCAGTTCCTTCTAGAGGTTTATA
TGTAGAGTACTCAGAACGTTTTACTAGGGACTTATGGATAATTGTACACC
CTTCAGGTTATGATGCTTATTATCAAGGAGAGAAATATGGTGGAGAGTCT
TTAGATGAGATTATACATGATATGTTTTATGATTATGCAGACCCTTTTGA
CTTAGATTATTAGAAAGGAGAGATTATAATGATAGAGATATACCTTAGTG
AAAATTATGATAAGAATTTACTAAAAGCAGAATTAAAATGGATTAAAGAG
ACCGCTTCAAGAGAACTAACTTATGATATTAATAGGAAACCTGGATTGGA
TGTTTATGTTAATCCCTATAGGTGTACTAAAGACGAAGTTGAAGAATGGA
GTACACTTCCTCCATTTGAAGATGATATACTTGTATTTATAGCGGAGACG
TGGATACATGAATATCTTAAGGGTGAATCAATAGGTGTAGATAGTATGGA
AGAGTATGTAAAGGAGATGTAACTAATGTTTAAGGTATATTATACAGTCT
ACCATAGAGGTAGTATGAAAACTATTAAGGATAAGCTAGATAGAAGTAGT
TTAAATACTTCTTGTATGGATACTTGGTATAAAGATATTAGTAACGTATT
CCCTAATCACTATAATAAAGAGTTTGGGAGTAAGAGTGATGATATAGATA
TAGATAAACTTATTGAAGCGGTTAATGAGGAAGGTATATTACTTATCAAT
AGAGGTAATTATGTTACAATAAGAGAATGGTAGGATAGGATAAACTTAGG
ATAGAAAATAATTTAGGATGAGTTACAATAGGATAGGATAGGATAGGGGG
TTAAGTTAGGATGGATACTTTAACATACACTATTATTCATAAAGAATCTG
ATAGGGTAATAGCTAGCGGTTTAAATGAGACAGAAACTATGAACTTAGTT
CAAAGGATGATAAATACTAATCTAGTTACTGATATATCATTAGATGATTA
TATACGCAGACCACATGGAAAGATAGATGTAGTCAATTTACTAGTAGATA
TTAGAAGACAAGGCGTATTTGATTTCAATCACATTTGGCACGTAGGATAG
GAGGGATAGGATGATAGTTATATATACAGATGTTTCTAAGGATTATTTAA
AAGACGAGTTCTTACCTTGGCTTAATGAAAGGGATAGATACTTAGAATAC
TATAAAGATGAATTACCTGAGGATATAGATTCCTCTTATATTGTATCAGT
TGTATACTGTAAGGATATGGAAGGTCTATTAGAAAGAAAAGACATTGTTC
TTGATAATAGTTATAATGAACCTGTAGCTTTATTAGGTGTTCCTGAGTTT
TTTGGTAATTATAGTAATTATTTCTATTATAGAGGAGAAACTATTACTAA
ACATCACCTAGGACAAATTCTTAGGTTAAAAGCTTGGCAACGTATGGGTG
GGGATTGACTAAGTAGCTCTCCCTAATTTCACTAAGTAGCTCCCTAGGAA
TTGCCTAAGTAGCTCGGTATGATTTTACCCTAAGTAGCTCCCTCTGTTTT
CTACTAGTTTATTTTAACCGCTTCAGGTGTCTATATATATATAGACGGTT
GGAATAATATCAGACCGCAAAAATAAATACACTAGGATATTATTCCCAGT
GTATTATATAATTTTTTATAGAATATTTATAACATTGTATTCAAATTCA
TTTACTTCATGTTGTGATTTAATTAAATTTTTAATTAATCCGTTTTGTGT
TTTATACTCTTTTATTAGTTTTTCATTTTCTATAATTAAATTATTAAATT
CTTCTTTTGTTGTTTCCTCATCTACATAAAATTTACTTTCATATATTTCA
```

```
TAATATTTTTTATCTGTTCCGCCATCTAAATCATCTGATATTTGATAATT
TTTGAATATAATTTCTTTTGTTTCTAATTCATTTACTAATAATTGTGATT
TTGCATATTGTAATACATCTTCATTGTCCCACATTGGAATATAGTTTATT
TTCATTTAAATCAAATCCTTTTCTTATAATTTTTTTATATAATATTTGTA
GAAGCGGTTGGGGTTTGTCCCTTGCCTTACTACACTTTATATATTACAGT
ATAGTTATTCAGAAGTCAATACTTTTGAGTAACTTTTTTTAAATTCTTTT
TTCTTCTATATAATAGTAGTTTTTAGCCCTAAAAATGTTTTTAAAAGAAT
TTGCATTTTCTTATTGACTTTATTATCATATGGTAGTAATATAAAGGTAC
AGCAAGGGAACAGCAACAAGATATTAGAATTATATAAAAAAATTATTTAA
TTTGAGATGATTTAAATGGATGTAAAAGAAATTGCAAATACTATAATGGA
GTTGTGGCAAATGGACGGCTACAGATGTGCAGAACCTCCATTATATGAAA
GCACACTAAACCACACACGCACACACACGGCGTTAATTGTTTCTATTAAT
GGAAACTATGACACAGTGCAGATGTTCCGCAAAACGCCTATAATGAGCAT
GAGAGGGCAAAGCGAACCGGCTAGCATGTTAGTTAATGTGATTGACGATG
TAATTATAATCGTATATGAAAATGTAGTGTACGGAGTTCAAAACAAAGAA
ATAAAATTTATTGAAGAAATTTAAAAATAGGGGTTGCAATCCTCAAGCAT
CTATAGTAATATAATAGGTGTAGGGGATAGCAACACACCTCAAAA
```

All publications mentioned in the above specification are herein incorporated by reference. Various modifications and variations of the described methods and system of the present invention will be apparent to those skilled in the art without departing from the scope and spirit of the present invention. Although the present invention has been described in connection with specific preferred embodiments, it should be understood that the invention as claimed should not be unduly limited to such specific embodiments. Indeed, various modifications of the described modes for carrying out the invention which are obvious to those skilled in biochemistry and biotechnology or related fields are intended to be within the scope of the following claims.

SEQUENCE LISTING (4 sequences)

SEQ ID NO: 1 - DNA, 127395 bp, Staphylococcus Bacteriophage K
  source 1..127395: mol_type = genomic DNA
ggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttggaacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatctaatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataagtgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaagttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgcagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaaatgtacggtaagtatttagatgagctaaacattgatgaatggtatgataagttactaaataatgatagtatcggtaaagtaaaacatgatgctagagaagttatgacagacattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaa

SEQ ID NO: 2 - DNA, 149108 bp, synthetic construct
  misc_feature 1..149108: note = Synthetic polynucleotide
  misc_feature 1..149108: note = Genomic Nucleic Acid Sequence of Sa87
  source 1..149108: mol_type = other DNA
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttaattgcatcaatcacgcctaagcttgtaaattggtttttactactacaagataacataaatatttttttaagataagtgttgacaacctagaaacaacatgttaatattaatatataccaaatgagaggaattgattaattatgaaaatgacaaaagaaaattacagtagagtattagaagtttacaaagagaataaggacttgatagcacgccacaaggagcatttaaaagccaatgcaacgtataaagatttaaacgttaggttagcatttgatatcttttactcacaactattcccactagaacaaagacgtatcataagccaatcaggaacggataatgacctatgtgatagccacttgcaaaccgcatttttaaaagccttgaatgaaattggtttaaaagaataaaaaaactttcaaataagggcttgacttccaagccctagcatgttattattaagataacaaataaaacaaaaaggaaatgatacaaatgaaaaacgtacaaaacttgaaattttactcttacagtggatttgaaagtccggaattattagcaattggatttgataacttaattaaagatttaactgtagaaagcaattacctaggtgacgtgacaaatgacactatagatgaattgacggattggttagatatctttgatactattgaagaaatgcaagaacaccatgaaaatgtagtaaatggaatttggattaatccaacatatgaaaatttaaaagattttaatttatcggttggacttgatgaaaatacttatatagaaagttttaaataagtgttgacaacttaaacaatacatgttattattaagatacaaggtaagggaagcggtcaaccgcttccaacctagtaaaaaaagttttaaaaaaactattgacaagtcacttagccacatgatatacttagtataacaaatcaaacagaaaaggaattgattataatgaaatttatcaaaactattgaaaacttattggaaaaagctgaaaacaaaggggaagcaattttaaatggtcgtatgaatttaggttggggaatggttggaagcctagaagaaaaatatgcaatcgagattcaagataataaattggttatgcgtcattggggaacagaaacaattgaggttgacttgacaagaagtgagattgtttcatactatggagaaagcaattcagaccgtgatagcttaaatacgcttgtatattgcctaggaatggagccaaacttccgttacttaccaagcaaaaatttattcatctatgaaaattaattaaataaagggcttgacttccaagccctaccatgttattattaaggtagttaaaaaatacaaatcagaaaaggaattgatgaaaatgtttaaattagaaaataaagtggaaattatcgtacctaaggaagataacaacggtgttgagattgacaacttagtaatccgtgaatcattagaaaatattactaaaatatgtggaggttgtaccactacagacgttaaaggtcaatggtggtcagacaatgaacaacgtatcatgcaagacaataacactaactttgaatggtactataacaaggatatggaggacgtgaacgaccaacaagggctattaaaaggcttatctactattactagaattctaatcactgagtacggtcaagaaggcattagcattaaaattaatgatacactatatatcattgatgaaagtgatttaaatttcttatcatatgaattatacgctttaatgtttaagaattaaataaaaaaattatataaaccgcttcttatttaataatttgaagcggttattttcttttaaattagggcttgacaaatgtacgaaaaaatgagataatgaagtgatgactttttttcgtataaaaataatattatataaaaaaattatagataaaaataccctccacgtccattataccaattttgctcccacttgtcaatacttaaattaattaaaaaagtttataaaaagtattgacatttcttacaatccatagtataatatagatataaggttaaggagcccaagaccaaagaaggggtttcgggggaagtccgtccttttttatataaaaaataaccgtccacctctattatctcaaattttgcccctagtgtcaagaactttctttgaaataatttatttaaaaaagtttcataaatctattgacttactattaattatggtgtaatatatagatataaggttaaggaagcggaacacttaaaaaataaattaaaaaaacttttaaaaaggtgttgacaaacttcaaaccacatgttaatattaagataacaaataaaacaaaaaggaattgataattatgaacagattagaaatagtaaaagacacggcaatggaatacatcattatgatggataacggagttatggacggacaattaacacaagaggaatacaacgaagcggttagctttgaaaaggtttacgattacactttatcagaagcaaatcaagaatgtaaattcttaggcggtaaaattttaactttcctagtaaatgaagcaattgaagaatacgcataaaaaaacttaataaaaggggttgacattcaacccctaccatgttaatattaatatataccaaatgagaggaattgataattatgagatacgaaatcgtaacattagttaatggagagctacttatgtacgcaacattcaacaagcaggaagcagaagcaaaatatagtgaatggtgtgacctgtacggtcaagaaaatgtaagcatggaaaaaaattaaaataagcggttgacaaaataaccgcttcatgataatattaaactatactaaagaaaaggaaatgattacaatgacaaaaacaatcaaacaattagaaagccaattagagaaactagaaagaaaatcagatgaggaattagcaaatggatactatgaagcatttgaaagaacttgcgcacatattagagaattagacctacaaatcgaattaaaaaagaattcagaaactgtttaaaaaatctaaataaggggttgacacttaaccccttacatgttaatattaagatagttaaaaaatacaaataagaaaaggaattgatacaaatgaaattaatcaatagagataatgaaatcgtaattagtatagcaacacttgagagcgtaaaacaagccctaatttgggagtatatcgaccacttagataataacatcctagacaaagaaatacacgaccaggaagcggttgtagtgacttctcacactttacaacaaatcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgattcctccttatctattgtaaaggatttacctgttctagagaatagtttaaacatttcttcttcaaaatattcatcactcatatctttatctttcaacatttcacagagtttgtcccatgcttctgctttattataaatggtttctacttctctatctgtttcatcactataattttcatatataatttgtaatacaaaatccttctcatcataacatttttcattaatatcatatttcattataattcctccttatattctttatagctcttgatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaagaatacagaaagtataattaacattataggaagggctacaaaaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacatagatatattcatttgagtcattttcataaataatatctatagctgtaatatctgaatatgctgtaatcatttcataagcgttcgtattatcagggtaagcaaaaccaacttgaggtatttccataggcttatcaataagaataccgaaataagtacagtgatgtgttcgacttatatttgaagtccctttatatgtaccatagtaatctataccttctgtaatacctgatatatggaacctgtttacgtctttaggttctaatcttacaacatcgcaattctctaatactaaatcaatatatttgatattcattttaactctcctttttatctttattataaatacaatgcacacggacatcttccattactttgcctaatagattctgacctttccagttactttgctctaatattttagggtcatttgctttaagacctactccccatattttatcataaggtgaagcttctacgaaatctttacgtacatctgtgtctaatattctttgctttaggtgtgtagtcataaatttatctttaactacttctaccataatatcatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttgatgtttaaactttatagggtagaagttagaataaatatcctctttaccccaaaacataatatattcacttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatggttactactctctacaaatgcgtttaagtcagcgtataactgaataaaaaaggacatgtcataattccaatacttaggctcatttctacctagttttttcttcattttcttgtattttttattcttttttagaccaaaaacttctttttcaaagtcatttaatttaagacctttaaaatattttttcttcatttcttaacctccaatttaataaatggaaaatcaatgtttctaaatactgcgcctacatcacacattaacatgtctccattaatttctacttctccactgtctgttggggtgtgaccacatacataggtaaaaccatcttttctaggttgaaagtctcttgaccatattaattggtcaattgtttgttcttctacaggcttccaactaaccccgcctgaatgagagaatatatacttgtcttctttatagtactttctacaattaaccataagtattttaaattttctatagtcgtctgattctttaagtttctttagttcacttttaataaaatcataattacttcttaggttttcttctacactactatactttaaagttaccgtactcacaccgtaagagttaagtgtttctatacaatatcttgagagccattcaatatcatagatacttaatcggtctacgttttccataatattataaaactcatcatcatggttgcctaatagtgttactacattatcatcattagacattaaatcaaatatataattaacaacgtcttttgaccttctacctctatctacataatctcctaagaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattagtttaaataggtgtccgacagagctcccgtacttagattacggttaataatattttacgacaattatatgagaccctctgtcgttgaaacgctcgtcactgcgctattccacaagatattttagaaggtagcttgtggaagaagattgttttttattgtacttagtttatacactcttaaaagtacatgtgtgctatatatttatacaccaagcgtttggtgttagatacggaatggagggacactaccatccggagtctacggtcagatacaaagcctctgccgggcaacatacggtatctctcgtatatcaggttgactagacctttagagtttttcactccttctcttataaccattaacttaagagaaataggttttacttagtagatatgaaacaataaatccacatacaatattaaatcatagtcaagtgattgcacatatgtctaatacctataagttttttgctagcctggtatatgtatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcctactctcattataaggttaaaaaggctaactgtgtttagcattatataagaggctttagttaactactatactaataatataccataaattatacttaatgtcaagttaatttatcaattgaatctataatttttgatgtgctacgtatatccgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtacccattaactcttttaagttcaagataactattatatctaaagtaacgttgttcttctattaacttatcttttgttagataaggatactcatttataaatataggattacttgttccatagttatctctaatatattctgcgtcctctaaggaatcagtataacctaaaacttcataacttgttgtatacactgtatcttcttcccacaagtcatagtccatttcctctatttcttcttctaatatataaatttttttcatatattactcccaaaccccaataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcgggtattgtcctagcattcttgttccattttcattataaaaagtatattctactacaataatattcatcatatctacatatatagcttctatatacggtgtaatattttcttcttcttgtatgtgcttacctatgatatcatataataattctgagtgtattcttttatctctcattatagacctccgtaaggaatgctacagttttgtctttcaaagatttttctactaattccatagcatctttatagtgtttgatattagattcattagacttaagtttatcttttacttcttgaattagaggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagtcaattcttctttttttagtatgttattaatattaccgataacagaatatgctataggcttaaaattagctctaacataagttaaaaatataaaatcatcataaaataaatctaaaacagttttattaaatctagtatttttagcttgctctaattgagcacataaattaagaacattatcaaacccactttttagtactaaagagataaatctttctattgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccatcctgctaaagcatccatagctatatcatattcttcttcatttttaattcttataattttctctatttcttcctttgcttgtttagaactaataaaatcaatatcagtatcctctaggttagttaattctaaattttttctaataaaattcttttgacttggtgttatagaattaactcttacattttcgtgatttagaaattggtaaaagtccatattactcatcctttttaacgtattctgccatatcttttaaaatacttagtacgtattctaaatctctatattggtcatctaatgaccctataatagcatacggtgtcatatcccaggcatgtgcacagtcaaaccctaatactctcttaccctcatagtcataatcatcgtaagtaatacctctatgagcacgtctttctaaggagtcatattctttttcattgatatccgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatacaagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttagtggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattataggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattatagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgacggggaatccaaagtatcattaaggaatagtattatattttttacttatgataatgatggaaattaccagtattggaatacacgaagtatagaaaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggagaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaatgggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggaaccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataagttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgtagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactattactactactattactactactattactactactaagtacctttgttatgtactactattactactactattactactactaagtacctttgttatgtactactattactactactattactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttaattgcatcaatcacgcctaagcttgtaaattggtttttactactacaagataacataaatatttttttaagataagtgttgacaacctagaaacaacatgttaatattaatatataccaaatgagaggaattgattaattatgaaaatgacaaaagaaaattacagtagagtattagaagtttacaaagagaataaggacttgatagcacgccacaaggagcatttaaaagccaatgcaacgtataaagatttaaacgttaggttagcatttgatatcttttactcacaactattcccactagaacaaagacgtatcataagccaatcaggaacggataatgacctatgtgatagccacttgcaaaccgcatttttaaaagccttgaatgaaattggtttaaaagaataaaaaaactttcaaataagggcttgacttccaagccctagcatgttattattaagataacaaataaaacaaaaaggaaatgatacaaatgaaaaacgtacaaaacttgaaattttactcttacagtggatttgaaagtccggaattattagcaattggatttgataacttaattaaagatttaactgtagaaagcaattacctaggtgacgtgacaaatgacactatagatgaattgacggattggttagatatctttgatactattgaagaaatgcaagaacaccatgaaaatgtagtaaatggaatttggattaatccaacatatgaaaatttaaaagattttaatttatcggttggacttgatgaaaatacttatatagaaagttttaaataagtgttgacaacttaaacaatacatgttattattaagatacaaggtaagggaagcggtcaaccgcttccaacctagtaaaaaaagttttaaaaaaactattgacaagtcacttagccacatgatatacttagtataacaaatcaaacagaaaaggaattgattataatgaaatttatcaaaactattgaaaacttattggaaaaagctgaaaacaaaggggaagcaattttaaatggtcgtatgaatttaggttggggaatggttggaagcctagaagaaaaatatgcaatcgagattcaagataataaattggttatgcgtcattggggaacagaaacaattgaggttgacttgacaagaagtgagattgtttcatactatggagaaagcaattcagaccgtgatagcttaaatacgcttgtatattgcctaggaatggagccaaacttccgttacttaccaagcaaaaatttattcatctatgaaaattaattaaataaagggcttgacttccaagccctaccatgttattattaaggtagttaaaaaatacaaatcagaaaaggaattgatgaaaatgtttaaattagaaaataaagtggaaattatcgtacctaaggaagataacaacggtgttgagattgacaacttagtaatccgtgaatcattagaaaatattactaaaatatgtggaggttgtaccactacagacgttaaaggtcaatggtggtcagacaatgaacaacgtatcatgcaagacaataacactaactttgaatggtactataacaaggatatggaggacgtgaacgaccaacaagggctattaaaaggcttatctactattactagaattctaatcactgagtacggtcaagaaggcattagcattaaaattaatgatacactatatatcattgatgaaagtgatttaaatttcttatcatatgaattatacgctttaatgtttaagaattaaataaaaaaattatataaaccgcttcttatttaataatttgaagcggttattttcttttaaattagggcttgacaaatgtacgaaaaaatgagataatgaagtgatgactttttttcgtataaaaataatattatataaaaaaattatagataaaaataccctccacgtccattataccaattttgctcccacttgtcaatacttaaattaattaaaaaagtttataaaaagtattgacatttcttacaatccatagtataatatagatataaggttaaggagcccaagaccaaagaaggggtttcgggggaagtccgtccttttttatataaaaaataaccgtccacctctattatctcaaattttgcccctagtgtcaagaactttctttgaaataatttatttaaaaaagtttcataaatctattgacttactattaattatggtgtaatatatagatataaggttaaggaagcggaacacttaaaaaataaattaaaaaaacttttaaaaaggtgttgacaaacttcaaaccacatgttaatattaagataacaaataaaacaaaaaggaattgataattatgaacagattagaaatagtaaaagacacggcaatggaatacatcattatgatggataacggagttatggacggacaattaacacaagaggaatacaacgaagcggttagctttgaaaaggtttacgattacactttatcagaagcaaatcaagaatgtaaattcttaggcggtaaaattttaactttcctagtaaatgaagcaattgaagaatacgcataaaaaaacttaataaaaggggttgacattcaacccctaccatgttaatattaatatataccaaatgagaggaattgataattatgagatacgaaatcgtaacattagttaatggagagctacttatgtacgcaacattcaacaagcaggaagcagaagcaaaatatagtgaatggtgtgacctgtacggtcaagaaaatgtaagcatggaaaaaaattaaaataagcggttgacaaaataaccgcttcatgataatattaaactatactaaagaaaaggaaatgattacaatgacaaaaacaatcaaacaattagaaagccaattagagaaactagaaagaaaatcagatgaggaattagcaaatggatactatgaagcatttgaaagaacttgcgcacatattagagaattagacctacaaatcgaattaaaaaagaattcagaaactgtttaaaaaatctaaataaggggttgacacttaaccccttacatgttaatattaagatagttaaaaaatacaaataagaaaaggaattgatacaaatgaaattaatcaatagagataatgaaatcgtaattagtatagcaacacttgagagcgtaaaacaagccctaatttgggagtatatcgaccacttagataataacatcctagacaaagaaatacacgaccaggaagcggttgtagtgacttctcacactttacaacaaatcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacc

SEQ ID NO: 3 - DNA, 148312 bp, synthetic construct
  misc_feature 1..148312: note = Synthetic polynucleotide
  misc_feature 1..148312: note = Genomic Nucleic Acid Sequence of J-Sa36
  source 1..148312: mol_type = other DNA
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccatatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgcgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagtcgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctataggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttggaacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatctaatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataagtgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaagaggacaacgtactctagaagaaatgattgaattcattagaatcagagatgtatccttcgaagttaaaggactaaaccctaatgataataatttatatttattatttgatggagtaagatgtgctataacacctgcaactggctataggaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaagttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccagggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgggcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgcagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaaatgtacggtaagtatttagatgagctaaacattgatgaatggtatgataagttactaaataatgatagtatcggtaaagtaaaacatgatgctagagaagttatgacagacattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattacggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttcattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgagaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagcccttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgtaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtggaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggagtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctagagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgggattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaatggtattattgtattttacaaagaagaaaataaacatattctaaagaagctcttagaattcattaacacaacatcaaaaggattaacttacaccttagagggtacattagttgataatgatatcgttttacttaaagataacaacatatgtgattataacctaagacagtttagtaagacaaatgatggcttagttataggtctattgagtgaatcatataatgatgttcattactatgaaaaaggagatgcctacggtatagaaagattaactatgtatttagaggagatgagtcaataatggtaattgcattttttattttaggtctattattagtattatgtttagttggtcttgctattattaaagtactagaagcaaggctaaagaaaaaagaactaaggagagaaagagaatcttttggtattcctgaaccagggagaaaattagggcacataggatatgtcgaaagtaaatatgctttaattcataaagaatcaagtaagataataataagcgcagagaaaagtaaagttgtagaaacattacagaaaatgtataatttagagttaacatctgtagatgtttctagtgtaacgggactctctcccttaggtacaggacgtatggagaatatggtattgctttcatacaaactagaaagagaatgactttataaattaattgaacttaataaggagtgatacaatggaatttatagataaaaataatgtaattaaagcttatgatataccgaatgtttacttaaaaggttacgtattgtatgcatgtgataaaaatggagacattacaacctatgatgggtatgaccaaatacactataaagatggtagagtattaacattcccttttgataagccgttaagaaagataaatgtactttcaggatattacaaactatttaagaaggaggacatactatgatttattttgttagtgatttacattttggtcatgataatattagagaatttgaagcacctacaagaagtcattggaattcagtagaagaaatgactgaaggtttgattgaactatggaataacacaattacaaataatgatattgtttataatatcggagacttcttctttaatatgaaaccatctaaagtagaagaaatacttaatagactaaattacaaagagatgacattgattgcaggtaatcatgaccataaaaagcttgttaagctatatgaacgtaatggtatcacagtgaagtatgctgatatgcttaagaaggaaggtaaaagattttatctgagtcactaccctacacttattggaagaaagaatatgtttaatattcatggtcatatacattcacaactaatggatactgattaccacattaatgtaggttatgatgtagaaggaaagattgcatatagttttgatgatattctaagtatagcaggtgagtatagtggagaaattcaaaggtaaagacttatataagactagaattagaaaacaaacaattaaaaatttaattattaaagtagagaaattacataataaacatagcccttatcaacctattggtcatgtttattattaccctaaaacaaaagagtttactttatctaaacccgagcaaaagatatttatagagtatatgaaagaattaggttttaatgtaaaacacaagagacgtaagaaaacacttattatttataagaatgcattcactgaatacattagtaggtatcatgaagcaatagagcagattgaaggagggaaataatggaatatttatttttatttataggtattggcatgataatttggggtttcatagcaccttatcttgcatttgtagtttactataaacatgtaagagaaaatcataatggattcagtgatgaggaatctctagaagaggctatagtatttggtatgggattcatgtttatagcatttattcctataggtatactagttgtaattgaagaaattaagattttattcttttaaatgttgacagctacaatatagtgtgttacagtatagaaaaggaggttaattaatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacc

SEQ ID NO: 4 - DNA, 146004 bp, synthetic construct
  misc_feature 1..146004: note = Synthetic polynucleotide
  misc_feature 1..146004: note = Genomic Nucleic Acid Sequence of Sa83
  source 1..146004: mol_type = other DNA
ggaattcttttacctctctcactcagcctattacttattaccgacttccataactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatacattaaattttgcactagataatgttaaagaaatagaagcggttaagaattaaaaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagtggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttactttgacggatatagtaaaggtgaacttgaagaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaataggctagtgcatctttaaactctaacttaaggatatccttatatttaatcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttatggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaataagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccaggtaaaaaacaacaacaatctcaaaataaaggtttacaacctttacttagatttattgaagacttagttaatagacatattatatcagaatatggagataagtatacattccaattcgtaggtggagatactaagagtgctacggataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaaattattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtagggagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggcggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttatctaaatatattccataatgatatcctggatttattaagttctaagaaaatcaatgctagtgagtctgttagactcgataaattatctattggtgttacaatccctaacaaatttatggagttagttaaagaaggtaaacctttctatacttttgatacttacgacattaataaagtgtacggtaagtatttagatgagctaaacattgatgaatggtatgataagttactaaataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggcggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataagttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactattactactactaagtacctttgttatgtactactattactactactaagtacctttgttatgtactactattactactactattactactactattactattactactactattactactactaagtacctgggaattcttttacctctctcactcagcctattacttattaccgacttccataactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatacattaaattttgcactagataatgttaaagaaatagaagcggttaagaattaaaaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagtggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttactttgacggatatagtaaaggtgaacttgaagaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacc

The invention claimed is:

1. A therapeutic bacteriophage composition formulated for treating a bacterial infection in a human subject in need thereof, comprising one or more bacteriophages selected from a bacteriophage having at least 90% sequence identity across its entire genome when compared to Sa87 (SEQ ID NO:2), a bacteriophage having at least 90% sequence identity across its entire genome when compared to J-Sa36 (SEQ ID NO:3), a bacteriophage having at least 90% sequence identity across its entire genome when compared to Sa83 (SEQ ID NO:4); and wherein the composition comprises a single dosage of $1\times10^7$ to $1\times10^{11}$ PFU of each phage per mL of composition.

2. A bacteriophage composition according to claim 1 comprising at least two bacteriophages selected from a bacteriophage having at least 90% sequence identity across its entire genome when compared to Sa87 (SEQ ID NO:2), a bacteriophage having at least 90% sequence identity across its entire genome when compared to J-Sa36 (SEQ ID NO:3), and a bacteriophage having at least 90% sequence identity across its entire genome when compared to Sa83 (SEQ ID NO:4).

3. A bacteriophage composition according to claim 1, comprising bacteriophages having at least 97% sequence identity to each of Sa87 (SEQ ID NO:2), J-Sa36 (SEQ ID NO:3), and Sa83 (SEQ ID NO:4).

4. A bacteriophage composition according to claim 1 consisting essentially of bacteriophage having at least 98% sequence identity to each of Sa87 (SEQ ID NO:2), J-Sa36 (SEQ ID NO:3), and Sa83 (SEQ ID NO:4).

5. A bacteriophage composition according to claim 1, wherein the one or more bacteriophages has at least 95% sequence identity across its entire genome when compared to Sa87 (SEQ ID NO:2), at least 95% sequence identity across its entire genome when compared to J-Sa36 (SEQ ID NO:3), or at least 95% sequence identity across its entire genome when compared to Sa83 (SEQ ID NO:4).

6. A bacteriophage composition according to claim 1, further comprising a pharmaceutically acceptable carrier, diluent, excipient or combinations thereof.

7. A bacteriophage composition according to claim 1 for use as a medicament.

8. A bacteriophage composition according to claim 1 for use in treating a bacterial infection.

9. A method of treating a bacterial infection comprising administering the bacteriophage composition according to claim 1 to a subject.

10. A method according to claim 9, wherein the bacterial infection is a *Staphylococcus aureus* bacterial infection.

11. The method of claim 10, wherein the bacterial infection is a pulmonary bacterial infection.

12. A kit comprising:
  a. a bacteriophage composition comprising one or more bacteriophages selected from a bacteriophage having at least 90% sequence identity across its entire genome when compared to Sa87 (SEQ ID NO:2), a bacteriophage having at least 90% sequence identity across its entire genome when compared to J-Sa36 (SEQ ID NO:3), and a bacteriophage having at least 90% sequence identity across its entire genome when compared to Sa83 (SEQ ID NO:4), for use in a method of treating a pulmonary bacterial infection; and
  b. instructions for use of the composition.

13. A kit according to claim 12, further comprising an antibiotic and instructions for use of the antibiotic in combination with the bacteriophage composition.

14. A kit according to claim 12, wherein said instructions are for use of the composition in treating a pulmonary *Staphylococcus aureus* infection.

15. A method of killing bacteria on a surface, said method comprising applying a bacteriophage composition according to claim 1 to the surface.

16. A method according to claim 15, wherein the surface is the skin of a mammal, equipment, bedding, furniture, walls, floors, or combinations thereof.

17. The method of claim 16, wherein the equipment is medical equipment.

18. The composition of claim 1, further comprising an antibiotic.

19. The composition of claim 1, wherein the composition comprises about $1 \times 10^{11}$ PFU/mL per phage.

20. The kit of claim 12, wherein the composition comprises about $1 \times 10^{11}$ PFU/mL per phage.

21. The composition of claim 1, wherein the bacterial infection comprises a *Staphylococcus aureus* infection.

22. A method of treating a bacterial infection comprising administering the bacteriophage composition according to claim 2 to a subject.

23. A method of treating a bacterial infection comprising administering the bacteriophage composition according to claim 3 to a subject.

24. A method of treating bacterial infection comprising administering the bacteriophage composition according to claim 4 to a subject.

25. A method of treating a bacterial infection comprising administering the bacteriophage composition according to claim 5 to a subject.

26. The composition of claim 1, wherein the one or more bacteriophages comprises a bacteriophage having at least 90% sequence identity across its entire genome when compared to Sa87 (SEQ ID NO:2).

27. The composition of claim 1, wherein the one or more bacteriophages comprises a bacteriophage having at least 90% sequence identity across its entire genome when compared to J-Sa36 (SEQ ID NO:3).

28. The composition of claim 1, wherein the one or more bacteriophages comprises a bacteriophage having at least 90% sequence identity across its entire genome when compared to Sa83 (SEQ ID NO:4).

29. The composition of claim 1, wherein the one or more bacteriophages comprises a bacteriophage having at least 95% sequence identity across its entire genome when compared to Sa87 (SEQ ID NO:2).

30. The composition of claim 1, wherein the one or more bacteriophages comprises a bacteriophage having at least 95% sequence identity across its entire genome when compared to J-Sa36 SEQ ID NO:3).

31. The composition of claim 1, wherein the one or more bacteriophages comprises a bacteriophage having at least 95% sequence identity across its entire genome when compared to Sa83 (SEQ ID NO:4).

* * * * *